US012540315B2

(12) United States Patent
Mendez et al.

(10) Patent No.: US 12,540,315 B2
(45) **Date of Patent: *Feb. 3, 2026**

(54) COMPOSITIONS AND METHODS FOR USING GENETICALLY MODIFIED ENZYMES

(71) Applicant: RENEW BIOPHARMA, INC., San Diego, CA (US)

(72) Inventors: Michael Mendez, San Diego, CA (US); Joseph Noel, San Diego, CA (US); Michael Burkart, San Diego, CA (US); Jeremy Lanoiselee, San Diego, CA (US); Kyle Botsch, La Mesa, CA (US); Matthew Saunders, San Diego, CA (US)

(73) Assignee: Renew Biopharma, Inc., San Diego, CA (US)

( * ) Notice: Subject to any disclaimer, the term of this patent is extended or adjusted under 35 U.S.C. 154(b) by 576 days.

This patent is subject to a terminal disclaimer.

(21) Appl. No.: 17/602,676

(22) PCT Filed: Apr. 13, 2020

(86) PCT No.: PCT/US2020/027955

§ 371 (c)(1),
(2) Date: Oct. 8, 2021

(87) PCT Pub. No.: WO2020/210810

PCT Pub. Date: Oct. 15, 2020

(65) Prior Publication Data

US 2023/0029027 A1 Jan. 26, 2023

Related U.S. Application Data

(60) Provisional application No. 62/833,449, filed on Apr. 12, 2019.

(51) Int. Cl.

| | |
|---|---|
| ***C12N 9/10*** | (2006.01) |
| ***C12P 7/22*** | (2006.01) |
| ***C12P 7/42*** | (2006.01) |
| ***C12P 17/06*** | (2006.01) |

(52) U.S. Cl.
CPC .............. *C12N 9/1085* (2013.01); *C12P 7/22* (2013.01); *C12P 7/42* (2013.01); *C12P 17/06* (2013.01); *C12Y 205/01001* (2013.01)

(58) Field of Classification Search
CPC ............ C12N 9/1085; C12P 7/22; C12P 7/42; C12P 17/06; C12Y 205/01001
See application file for complete search history.

(56) References Cited

U.S. PATENT DOCUMENTS

| | | | | |
|---|---|---|---|---|
| 7,361,483 | B2 | 4/2008 | Kuzuyama et al. | |
| 7,544,498 | B2 | 6/2009 | Kuzuyama et al. | |
| 8,124,390 | B2 * | 2/2012 | Kuzuyama | C12N 9/1085 435/193 |
| 8,884,100 | B2 | 11/2014 | Page et al. | |
| 9,394,510 | B2 | 7/2016 | Peet et al. | |
| 9,512,391 | B2 | 12/2016 | Peet et al. | |
| 9,546,362 | B2 | 1/2017 | Page et al. | |
| 9,587,212 | B2 | 3/2017 | Winnicki et al. | |
| 9,611,460 | B2 | 4/2017 | Page et al. | |
| 9,657,316 | B2 | 5/2017 | Burgard et al. | |
| 9,765,308 | B2 | 9/2017 | Page et al. | |
| 9,822,384 | B2 | 11/2017 | Poulos et al. | |
| 9,861,609 | B2 | 1/2018 | Winnicki et al. | |
| 9,879,292 | B2 | 1/2018 | Winnicki et al. | |
| 10,059,971 | B2 | 8/2018 | Page et al. | |
| 10,093,949 | B2 | 10/2018 | Poulos et al. | |
| 10,718,000 | B2 | 7/2020 | Page et al. | |
| 10,894,952 | B2 * | 1/2021 | Mendez | C12P 7/42 |
| 11,920,166 | B2 | 3/2024 | Botsch et al. | |
| 2005/0221459 | A1 | 10/2005 | Taylor et al. | |
| 2006/0183211 | A1 | 8/2006 | Kuzuyama et al. | |
| 2009/0047719 | A1 | 2/2009 | Burgard et al. | |
| 2010/0285502 | A1 | 11/2010 | Kuzuyama et al. | |
| 2012/0144523 | A1 | 6/2012 | Page et al. | |
| 2014/0058056 | A1 | 2/2014 | Burgard et al. | |
| 2015/0128301 | A1 | 5/2015 | Page et al. | |

(Continued)

FOREIGN PATENT DOCUMENTS

| | | | |
|---|---|---|---|
| DE | 102010011601 | A1 | 9/2011 |
| EP | 2732037 | B1 | 12/2017 |

(Continued)

OTHER PUBLICATIONS

UniProt Accession No. L7UI20_MYXSD (1 page, Apr. 3, 2019) (Year: 2019).*
Li et al. (Plant Physiol, 2015, 167:650) (Year: 2015).*
Qian et al. (Biotechnol Bioeng, 2019, 116:1116) (Year: 2019).*
Singh et al. (Curr. Protein Pept. Sci. 18:1-11, 2017) (Year: 2017).*
Zhang et al. (Structure 26:1474-1485, 2018) (Year: 2018).*
Hanus et al. (Nat Prod Rep, 2016, 33:1357) (Year: 2016).*
GenBank Accession No. AB187169.1, "*Streptomyces* sp. CL190 gene for prenyltransferase, complete cds," Oct. 29, 2015, retrieved from https://www.ncbi.nlm.nih.gov/nuccore/AB187169.1?from=1&to=924, 2 pages.
International Preliminary Report on Patentability for International Application No. PCT/US2020/027955, dated Oct. 21, 2021, 7 pages.

(Continued)

*Primary Examiner* — David Steadman
*Assistant Examiner* — Joseph R Spangler
(74) *Attorney, Agent, or Firm* — COOLEY LLP

(57) ABSTRACT

The disclosure relates to the biosynthesis of cannabinoids and related prenylated phenolic compounds using recombinant enzymes. In particular, the disclosure provides recombinant prenyltransferase enzymes engineered to produce a greater amount of a desired product, or to have a greater ability to catalyze a reaction using a desired substrate, as compared to the wild type prenyltransferase. The disclosure also provides methods of preparing such recombinant enzymes; as well as methods of use thereof in improving the biosynthesis of cannabinoids and related prenylated phenolic compounds.

14 Claims, 97 Drawing Sheets

Specification includes a Sequence Listing.

(56) References Cited

U.S. PATENT DOCUMENTS

| | | | |
|---|---|---|---|
| 2016/0053220 | A1 | 2/2016 | Peet et al. |
| 2016/0264917 | A1 | 9/2016 | Peet et al. |
| 2016/0298151 | A1 | 10/2016 | Butt et al. |
| 2016/0340629 | A1 | 11/2016 | Winnicki et al. |
| 2017/0211049 | A1 | 7/2017 | Page et al. |
| 2017/0233778 | A1 | 8/2017 | Winnicki et al. |
| 2018/0155748 | A1 | 6/2018 | Butt et al. |
| 2018/0179564 | A1 | 6/2018 | Winnicki et al. |
| 2018/0320209 | A1 | 11/2018 | Rudenko et al. |
| 2018/0334692 | A1 | 11/2018 | Barr et al. |
| 2018/0371507 | A1 | 12/2018 | Poulos et al. |
| 2019/0169661 | A1 | 6/2019 | Page et al. |
| 2019/0185946 | A1 | 6/2019 | McKernan |
| 2020/0123511 | A1 | 4/2020 | Mendez et al. |
| 2021/0238561 | A1 | 8/2021 | Botsch et al. |
| 2021/0301267 | A1 | 9/2021 | Mendez et al. |
| 2022/0364066 | A1 | 11/2022 | Botsch et al. |
| 2022/0411766 | A1 | 12/2022 | Mendez et al. |
| 2023/0203455 | A1 | 6/2023 | Botsch et al. |

FOREIGN PATENT DOCUMENTS

| | | | |
|---|---|---|---|
| WO | WO-2006081537 | A2 | 8/2006 |
| WO | WO-2009094485 | A1 | 7/2009 |
| WO | WO-2011017798 | A1 | 2/2011 |
| WO | WO-2015051298 | A2 | 4/2015 |
| WO | WO-2017075208 | A1 | 5/2017 |
| WO | WO-2018200888 | A1 | 11/2018 |
| WO | WO-2018209143 | A1 | 11/2018 |
| WO | WO-2019014490 | A1 | 1/2019 |
| WO | WO-2019046941 | A1 | 3/2019 |
| WO | WO-2019173770 | A1 | 9/2019 |
| WO | WO-2019183152 | A1 | 9/2019 |
| WO | WO-2019209885 | A2 | 10/2019 |
| WO | WO-2019209885 | A3 | 1/2020 |
| WO | WO-2020028722 | A1 | 2/2020 |
| WO | WO-2020102541 | A1 | 5/2020 |
| WO | WO-2020210810 | A1 | 10/2020 |
| WO | WO-2021067748 | A1 | 4/2021 |
| WO | WO-2021081246 | A1 | 4/2021 |

OTHER PUBLICATIONS

International Search Report and Written Opinion of the International Searching Authority for International Application No. PCT/US2019/023046, dated Aug. 19, 2019.

International Search Report and Written Opinion of the International Searching Authority for International Application No. PCT/US2020/027955, dated Jul. 2, 2020.

Kuzuyama et al., "Structural basis for the promiscuous biosynthetic prenylation of aromatic natural products," Nature (2005) 435:983-987.

Schreckenbach, "Enzymatische Oligomerisierung von Alkendiphosphaten," Ph.D. Thesis, Mar. 22, 2017, 71 pages, retrieved from https://d-nb.info/1137206578/34.

Vickery, "Posttranslational modification of natural product biosynthetic enzymes in bacteria and plants," Ph.D. Thesis, University of California, San Diego, 2016, 185 pages, retrieved from https://escholarship.org/uc/item/02s8d2zp.

Austin et al., "An Aldol Switch Discovered in Stilbene Synthases Mediates Cyclization Specificity of Type III Polyketide Synthases," Chem Biol. Oct. 2004; 11(9):1179-94.

Flores-Sanchez, et al., "In silicio expression analysis of PKS genes isolated from *Cannabis sativa*," L. Genet Mol Biol. Oct. 2010;33(4):703-13. doi: 10.1590/S1415-47572010005000088. Epub Dec. 1, 2010. PMID: 21637580; PMCID: PMC3036156.

Gagne S J et al: "Identification of olivetolic acid cyclase from Cannabis sativa reveals a unique catalytic route to plant polyketides", Proceedings of the National Academy of Sciences, National Academy of Sciences, vol. 109, No. 31, Jul. 31, 2012 (Jul. 31, 2012 ), pp. 12811-12816, ISSN: 0027-8424, DOI: 10.1073/PNAS.1200330109 [retrieved on Jul. 16, 2012].

Iijima, et al., "Identification and Characterization of Daurichromenic Acid Synthase Active in Anti-HIV Biosynthesis," Plant Physiology Aug. 2017, 174 (4) 2213-2230.

International Preliminary Report on Patentability for International Application No. PCT/US2019/023046, dated Sep. 22, 2020, 7 pages.

International Preliminary Report on Patentability for International Application No. PCT/US2020/027955, dated Sep. 28, 2021, 6 pages.

Invitation to Pay Fees for International Application No. PCT/US2019/023046, dated Jun. 10, 2019, 3 pages.

Jez et al., "Expanding the biosynthetic repertoire of plant type III polyketide synthases by altering starter molecule specificity," PNAS Apr. 16, 2002 99 (8) 5319-5324. https://doi.org/10.1073/pnas.082590499.

Raharjo, et al., "Methods for the analysis of cannabinoids in biological materials: a review," Phytochem Anal. Mar.-Apr. 2004;15(2):79-94. doi: 10.1002/pca.753. PMID: 15116938.

Sirikantaramas, S., et al., "The Gene Controlling Marijuana Psychoactivity: Molecular Cloning and Heterologous Expression of Delta1-tetrahydrocannabinolic Acid Synthase From *Cannabis sativa* L," The Journal of Biological Chemistry, Sep. 2004, vol. 279(38), pp. 39767-39774.

Taura, et al., "Characterization of olivetol synthase, a polyketide synthase putatively involved in cannabinoid biosynthetic pathway," FEBS Lett. Jun. 18, 2009;583(12):2061-6. doi: 10.1016/j.febslet.2009.05.024. Epub May 19, 2009. PMID: 19454282.

Taura F., et al., Cannabidiolic-acid synthase, the chemotype-determining enzyme in the fiber-type Cannabis sativa. FEBS Letters, May 25, 2007, vol. 581, No. 16, pp. 2929-2934.

Tello, et al., "The ABBA family of aromatic prenyltransferases: broadening natural product diversity," Cell. Mol. Life Sci. 65 (2008) 1459-1463.

Bornscheuer, et al., "Survey of protein engineering strategies," Curr Protoc Protein Sci. Nov. 2011; Chapter 26:26.7.1-26.7.14.

Chica, et al., "Semi-rational approaches to engineering enzyme activity: combining the benefits of directed evolution and rational design," Curr Opin Biotechnol. Aug. 2005; 16(4):378-84.

Davis, et al., "Overproduction of acetyl-CoA carboxylase activity increases the rate of fatty acid biosynthesis in *Escherichia coli*," J Biol Chem. Sep. 15, 2000; 275(37):28593-8.

Degenhardt, et al., "Chapter 2—The Biosynthesis of Cannabinoids," Editor: V.R. Preedy, Handbook of Cannabis and Related Pathologies, Academic Press, 2017, pp. 13-23.

Hoffmeister, et al., "Mitochondrial trans-2-Enoyl-CoA Reductase of Wax Ester Fermentation from Euglena gracilis Defines a New Family of Enzymes Involved in Lipid Synthesis," Journal of Biological Chemistry, vol. 280, Issue 6, 2005, pp. 4329-4338.

Kojoma, et al., "DNA polymorphisms in the tetrahydrocannabinolic acid (THCA) synthase gene in "drug-type" and "fiber-type" *Cannabis sativa* L.," Forensic Sci Int. Jun. 2, 2006; 159(2-3):132-40. Epub Sep. 6, 2005.

Kumano, et al., "Chemoenzymatic syntheses of prenylated aromatic small molecules using Streptomyces prenyltransferases with relaxed substrate specificities," Bioorganic & Medicinal Chemistry, vol. 16, Issue 17, 2008, pp. 8117-8126.

Lin, et al., "Fed-batch culture of a metabolically engineered *Escherichia coli* strain designed for high-level succinate production and yield under aerobic conditions," Biotechnol Bioeng. Jun. 20, 2005; 90(6):775-9.

Luo, et al., "Complete biosynthesis of cannabinoids and their unnatural analogues in yeast," Nature 2019, 567:123-126.

Needleman, et al., "A general method applicable to the search for similarities in the amino acid sequence of two proteins," J Mol Biol. Mar. 1970; 48(3):443-53.

Shoyama, et al., "Structure and function of Δ1-tetrahydrocannabinolic acid (THCA) synthase, the enzyme controlling the psychoactivity of Cannabis sativa," J Mol Biol. Oct. 12, 2012; 423(1):96-105. Epub Jul. 2, 2012.

Stout, et al., "The hexanoyl-CoA precursor for cannabinoid biosynthesis is formed by an acyl-activating enzyme in Cannabis sativa trichomes," Plant J. Aug. 2012; 71(3):353-65. Epub Jun. 1, 2012.

(56) References Cited

OTHER PUBLICATIONS

Sumper, Manfred, "[4] Acetyl-CoA Carboxylase from Yeast EC 6.4.1.2 Acetyl-CoA: carbon-dioxide ligase (ADP forming)," Methods Enzym 1981; 71:34-37.
UniProt Accession No. A0A0E3TIL8, "Cannabidiolic acid synthase," Jun. 24, 2015, UniProt Consortium [online]; first posted Jun. 24, 2015, last update Jan. 24, 2024. Retrieved online at https://www.uniprot.org/uniprotkb/A0A0E3TIL8/history, 2 printed pages.
UniProt Accession No. A6P6V9, "Cannabidiolic acid synthase," Feb. 6, 2013, UniProt Consortium [online]; first posted Aug. 21, 2007, last update Mar. 27, 2024. Retrieved online at https://www.uniprot.org/uniprotkb/A6P6V9/history, 4 printed pages.
Valliere, et al., "A cell-free platform for the prenylation of natural products and application to cannabinoid production," Nat Commun. Feb. 4, 2019; 10(1):565, 9 pages. Erratum in: Nat Commun. May 24, 2019; 10(1):2363.
Yang, et al., "Catalytic mechanism of aromatic prenylation by NphB," Biochemistry. Mar. 27, 2012; 51(12):2606-18. Epub Mar. 12, 2012.
Yoshikuni, et al., "Pathway engineering by designed divergent evolution," Current Opinion in Chemical Biology, vol. 11, Issue 2, 2007, pp. 233-239.
Zirpel, et al., "Elucidation of structure-function relationship of THCA and CBDA synthase from *Cannabis sativa*L," J Biotechnol. Oct. 20, 2018; 284:17-26. Epub Jul. 24, 2018.

* cited by examiner

Heatmap of Prenylated Products produced from Orf2 Variants using OA as substrate and DMAPP as donor Heatmap of Prenylated Products produced from Orf2 Variants using OA as substrate and GPP as donor Heatmap of Prenylated Products produced from Orf2 Variants using OA as substrate and FPP as donor Heatmap of Prenylated Products produced from Orf2 Variants using O as substrate and GPP as donor Heatmap of Prenylated Products produced from Orf2 Variants using DVA as substrate and GPP as donor Heatmap of Prenylated Products produced from Orf2 Variants using DVA as substrate and FPP as donor FIG. 7: Heatmap of Prenylated Products produced from select Orf2 Variants using ORA as substrate and GPP as donor Heatmap of Prenylated Products produced from select Orf2 Variants using Apigenin as substrate and GPP as donor Heatmap of Prenylated Products produced from select Orf2 Variants using Naringenin as substrate and GPP as donor Heatmap of Prenylated Products produced from select Orf2 Variants using Resveratrol as substrate and GPP as donor FIG. 11: Heatmap of Prenylated Products produced from prenyltransferase enzymes using ORA as substrate and DMAPP as donor FIG. 12: Heatmap of Prenylated Products produced from prenyltransferase enzymes using DV as substrate and DMAPP as donor FIG. 13: Heatmap of Prenylated Products produced from prenyltransferase enzymes using DV as substrate and GPP as donor FIG. 14: Heatmap of Prenylated Products produced from prenyltransferase enzymes using DVA as substrate and DMAPP as donor FIG. 15: Heatmap of Prenylated Products produced from prenyltransferase enzymes using O as substrate and DMAPP as donor FIG. 16
Predicted Prenylation Products using OA as substrate and DMAPP as Donor
UNK1
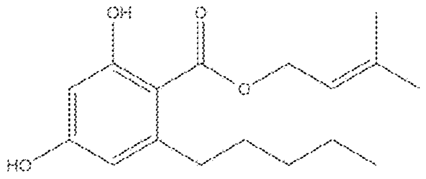
3-methylbut-2-en-1-y1 2,4-dihydroxy-6-pentylbenzoate
UNK3
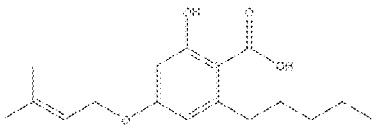
2-hydroxy-4-((3-methylbut-2-en-1-y1)oxy)-6-pentylbenzoic acid
UNK2
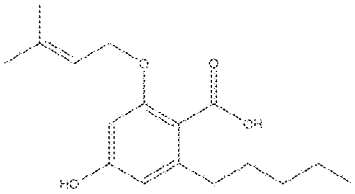
4-hydroxy-2-((3-methylbut-2-en-1-y1)oxy)-6-pentylbenzoic acid
RBI-17
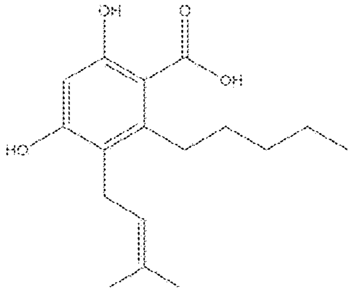
4,6-dihydroxy-3-(3-methylbut-2-en-1-y1)-2-pentylbenzoic acid
RBI-08
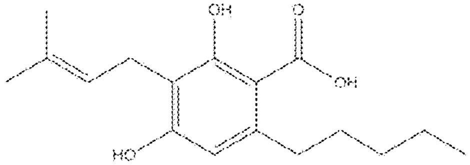
2,4-dihydroxy-3-(3-methylbut-2-en-1-y1)-6-pentylbenzoic acid

FIG.17

Predicted Prenylation Products using OA as substrate and GPP as Donor

RBI-05

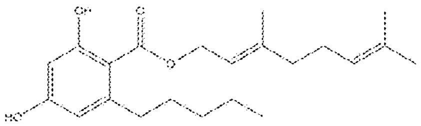

(*E*)-3,7-dimethylocta-2,6-dien-1-yl 2,4-dihydroxy-6-pentylbenzoate

RBI-06

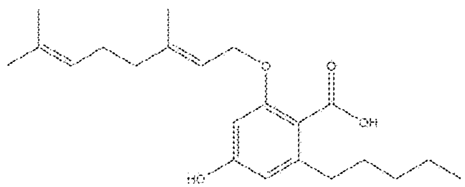

(*E*)-2-((3,7-dimethylocta-2,6-dien-1-yl)oxy-4-

UNK4

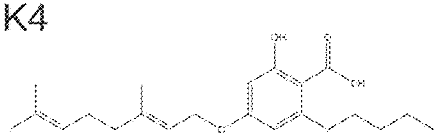

(*E*)-4-((3,7-dimethylocta-2,6-dien-1-yl)-2-hydroxy-6-pentylbenzoic acid

RBI-02 (CBGA)

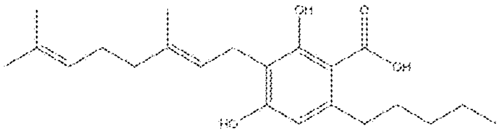

(*E*)-3,7-dimethylocta-2,6-dien-1-yl)-2,4-dihydroxy-6-pentylbenzoic acid

RBI-04

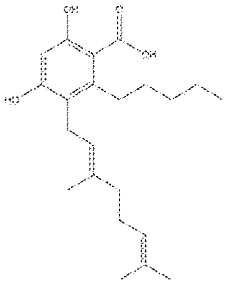

(*E*)-3,7-dimethylocta-2,6-dien-1-yl)-4,6-dihydroxy-2-pentylbenzoic acid

RBI-07

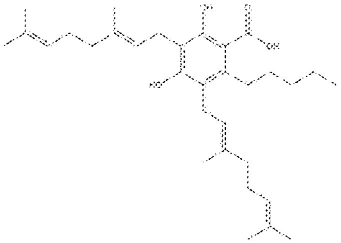

3,5-bis((*E*)-3,7-dimethylocta-2,6-dien-1-yl)-2,4-dihydroxy-6-pentylbenzoic acid FIG.18
Predicted Prenylation Products using OA as substrate and FPP as Donor
RBI-56
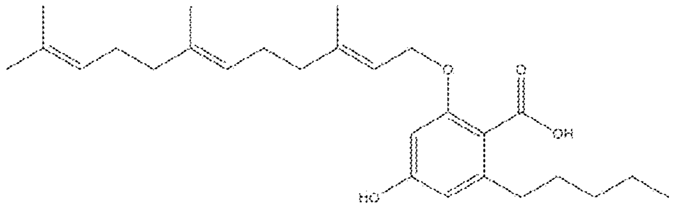
4-hydroxy-2-pentyl-6-(((2*E*,6*E*)-3,7,11-trimethyldodeca-2,6,10-trien-1-yl)oxy)benzoic acid
UNK5
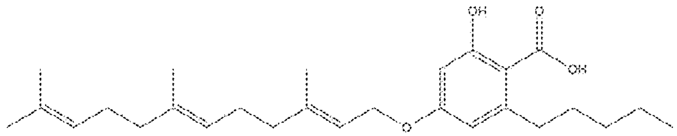
2-hydroxy-6-pentyl-4-(((2*E*,6*E*)-3,7,11-trimethyldodeca-2,6,10-trien-1-yl)oxy)benzoic acid
RBI-14
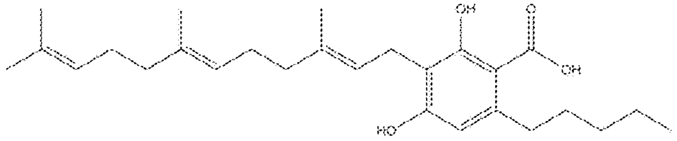
2,4-dihydroxy-6-pentyl-3-((2*E*,6*E*)-3,7,11-trimethyldodeca-2,6,10-trien-1-yl)benzoic acid
RBI-16
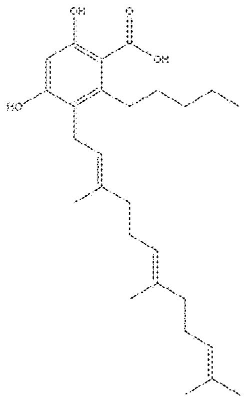
4,6-dihydroxy-2-pentyl-3-((2*E*,6*E*)-3,7,11-trimethyldodeca-2,6,10-trien-1-yl)benzoic acid FIG.19
Predicted Prenylation Products using O as substrate and GPP as Donor
RBI-03
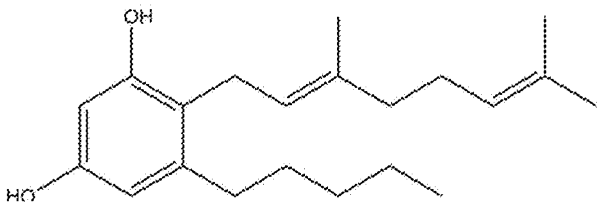
(*E*)-4-(3,7-dimethylocta-2,6-dien-1-yl)-5-pentylbenzene-1,3-diol
RBI-20
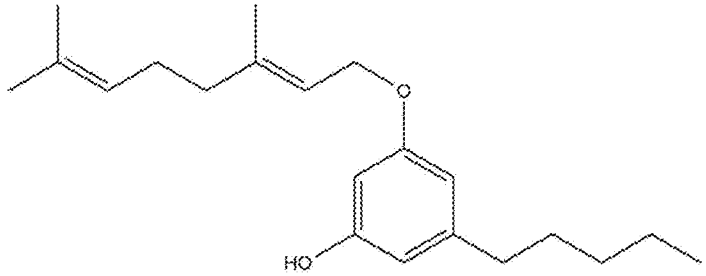
(*E*)-3-((3,7-dimethylocta-2,6-dien-1-yl)oxy)-5-pentylphenol
RBI-01(CBG)
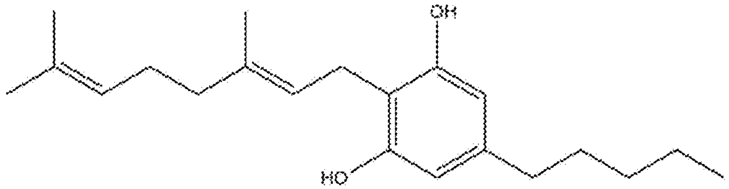
(*E*)-2-(3,7-dimethylocta-2,6-dien-1-yl)-5-pentylbenzene-1,3-diol

FIG. 20

Predicted Prenylation Products using DVA as substrate and GPP as Donor

RBI-24

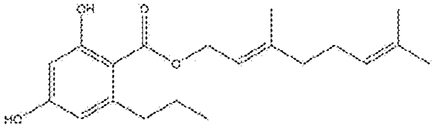

(*E*)-3,7-dimethylocta-2,6-dien-1-yl 2,4-dihydroxy-6-propylbenzoate

RBI-28

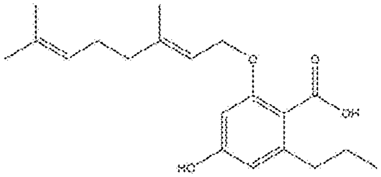

(*E*)-2-((3,7-dimethylocta-2,6-dien-1-yl)oxy)-4-hydroxy-6-propylbenzoic acid

UNK11

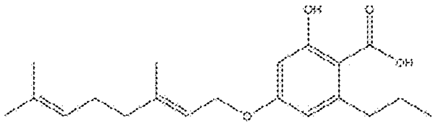

(*E*)-4-((3,7-dimethylocta-2,6-dien-1-yloxy)-2-hydroxy-6-propylbenzoic acid

RBI-26

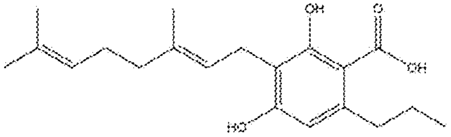

(*E*)-3-(3,7-dimethylocta-2,6-dien-1-yl)-2,4-dihydroxy-6-propylbenzoic acid

RBI-27

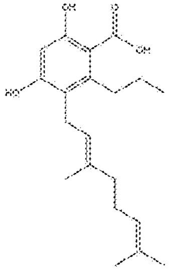

(*E*)-3-((3,7-dimethylocta-2,6-dien-1-yl)-4-dihydroxy-2-propylbenzoic acid

RBI-29

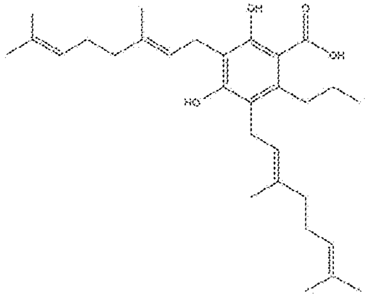

3,5-bis((*E*)-3,7-dimethylocta-2,6-dien-1-yl)-2,4-dihydroxy-6-propylbenzoic acid

FIG. 21

Predicted Prenylation Products using DVA as substrate and FPP as Donor

UNK12

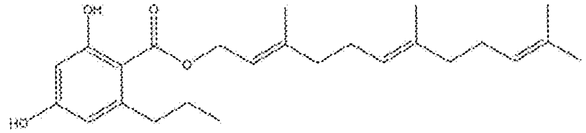

(2*E*,6*E*)-3,7,11-trimethyldodeca-2,6,10-trien-1-yl 2,4-dihydroxy-6-propylbenzoate

UNK13

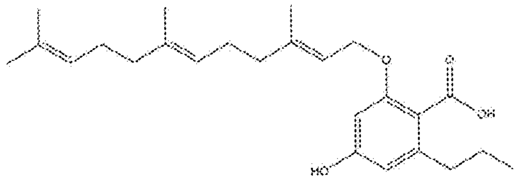

4-hydroxy-2-propyl-6-(((2*E*,6*E*)-3,7,11-trimethyldodeca-2,6,10-trien-1-yl)oxy)benzoic acid

UNK14

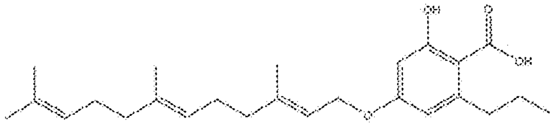

2-hydroxy-6-propyl-4-(((2*E*,6*E*)-3,7,11-trimethyldodeca-2,6,10-trien-1-yl)oxy)benzoic acid

RBI-38

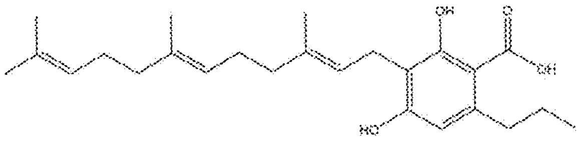

2,4-dihydroxy-6-propyl-3-((2*E*,6*E*)-3,7,11-trimethyldodeca-2,6,10-trien-1-yl)benzoic acid

RBI-39

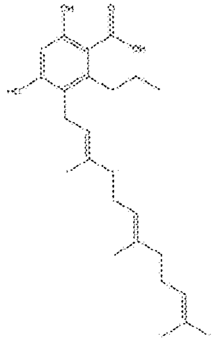

4,6-dihydroxy-2-propyl-3-((2*E*,6*E*)-3,7,11-trimethyldodeca-2,6,10-trien-1-yl)benzoic acid

FIG. 22

Predicted Prenylation Products using ORA as substrate and GPP as Donor

UNK20

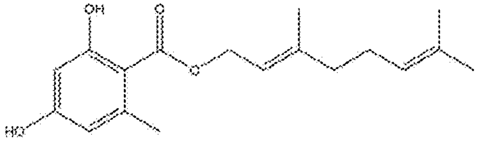

(*E*)-3,7-dimethylocta-2,6-dien-1-yl 2,4-dihydroxy-6-methylbenzoate

UNK21

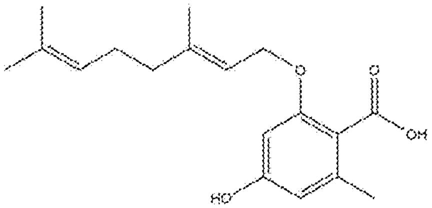

(*E*)-2-((3,7-dimethylocta-2,6-dien-1-yl)oxy)-4-hydroxy-6-methylbenzoic acid

UNK22

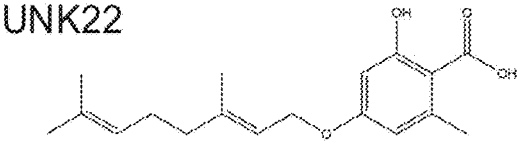

(*E*)-4-((3,7-dimethylocta-2,6-dien-1-yl)oxy)-2-hydroxy-6-methylbenzoic acid

UNK23

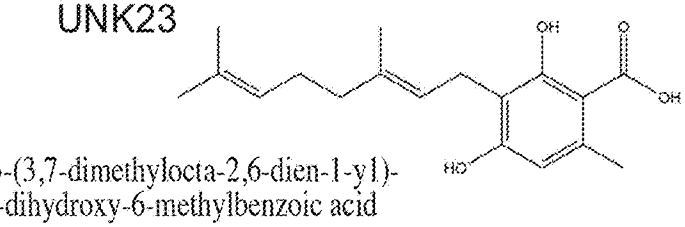

(*E*)-3-(3,7-dimethylocta-2,6-dien-1-yl)-2,4-dihydroxy-6-methylbenzoic acid

UNK24

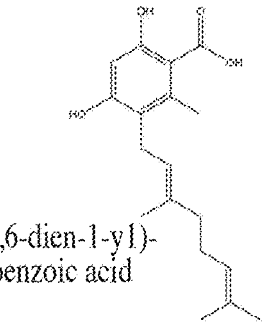

(*E*)-3-(3,7-dimethylocta-2,6-dien-1-yl)-4,6-dihydroxy-2-methylbenzoic acid

UNK59

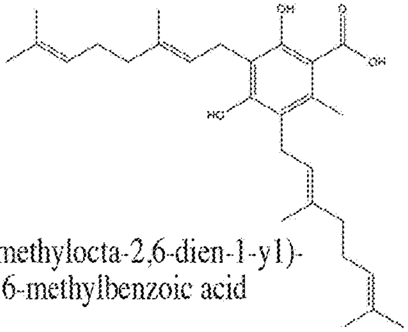

3,5-bis((*E*)-3,7-dimethylocta-2,6-dien-1-yl)-2,4-dihydroxy-6-methylbenzoic acid FIG. 23
Predicted Prenylation Products using Apigenin as substrate and GPP as Donor

UNK47

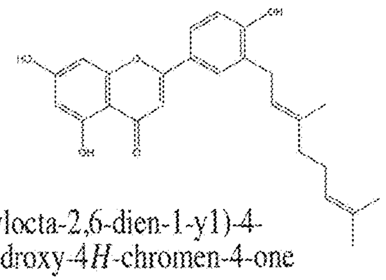

(*E*)-2-(3-(3,7-dimethylocta-2,6-dien-1-yl)-4-hydroxyphenyl)-5,7-dihydroxy-4*H*-chromen-4-one

UNK48

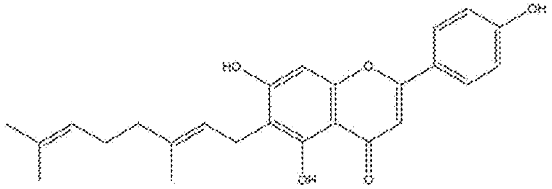

(*E*)-6-(3,7-dimethylocta-2,6-dien-1-yl)-5,7-dihydroxy-2-(4-hydroxyphenyl)-4*H*-chromen-4-one

UNK49

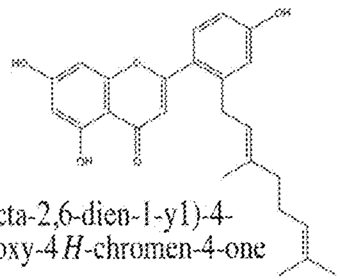

(*E*)-2-(2-(3,7-dimethylocta-2,6-dien-1-yl)-4-hydroxyphenyl)-5,7-dihydroxy-4*H*-chromen-4-one

UNK50

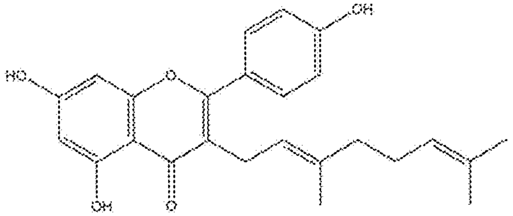

(*E*)-3-(3,7-dimethylocta-2,6-dien-1-yl)-5,7-dihydroxy-2-(4-hydroxyphenyl)-4*H*-chromen-4-one

UNK51

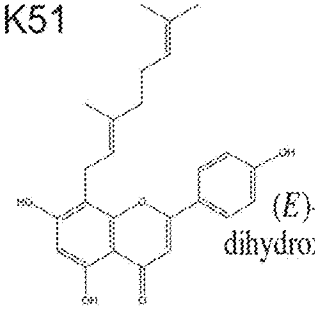

(*E*)-8-(3,7-dimethylocta-2,6-dien-1-yl)-5,7-dihydroxy-2-(4-hydroxyphenyl)-4*H*-chromen-4-one FIG. 24: Predicted Prenylation Products using Naringenin as substrate and GPP as Donor
RBI-41
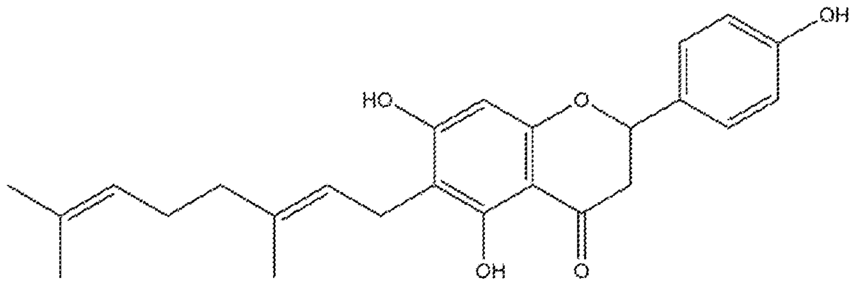
(*E*)-6-(3,7-dimethylocta-2,6-dien-1-yl)-5,7-dihydroxy-2-(4-hydroxyphenyl)chroman-4-one
RBI-42
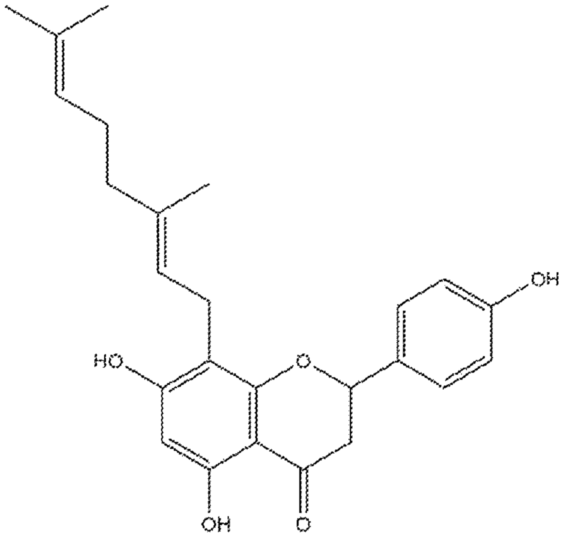
(*E*)-8-(3,7-dimethylocta-2,6-dien-1-yl)-5,7-dihydroxy-2-(4-hydroxyphenyl)chroman-4-one FIG. 25: Predicted Prenylation Products using Reservatrol as substrate and GPP as Donor
RBI-48
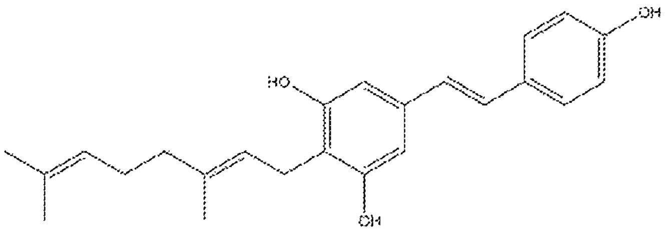
2-((E)-3,7-dimethylocta-2,6-dien-1-yl)-5-((E)-4-hydroxystyryl)benzene-1,3-diol
RBI-49
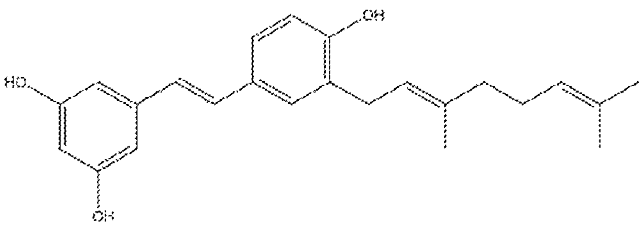
5-((E)-3-((E)-3,7-dimethylocta-2,6-dien-1-yl)-4-hydroxystyryl)benzene-1,3-diol
UNK52
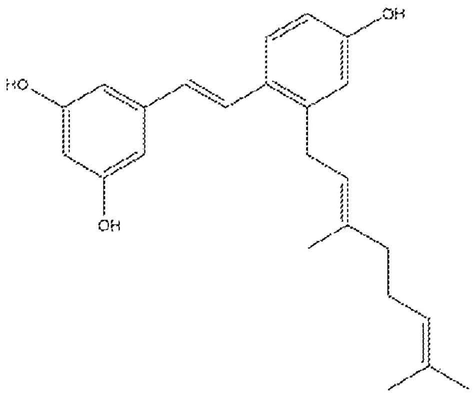
5-((E)-2-((E)-3,7-dimethylocta-2,6-dien-1-yl)-4-hydroxystyryl)benzene-1,3-diol
UNK53
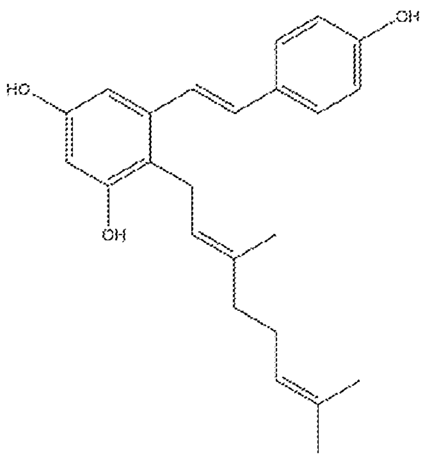
4-((E)-3,7-dimethylocta-2,6-dien-1-yl)-5-((E)-4-hydroxystyryl)benzene-1,3-diol FIG. 26: Predicted Prenylation Products using ORA as substrate and DMAPP as Donor
UNK25
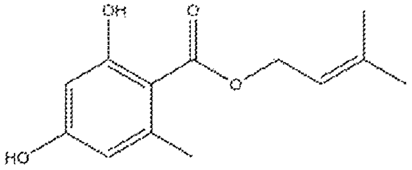
3-methylbut-2-en-1-yl 2,4-dihydroxy-6-methylbenzoate
UNK26
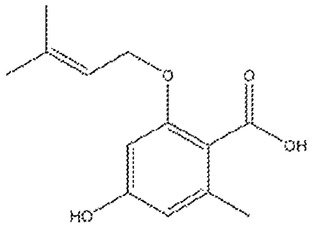
4-hydroxy-2-methyl-6-((3-methylbut-2-en-1-yl)oxy)benzoic acid
UNK27
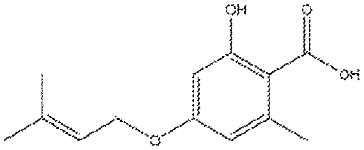
2-hydroxy-6-methyl-4-((3-methylbut-2-en-1-yl)oxy)benzoic acid
UNK28
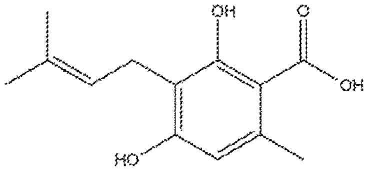
2,4-dihydroxy-6-methyl-3-(3-methylbut-2-en-1-yl)benzoic acid
UNK29
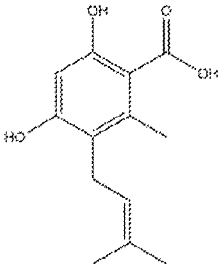
4,6-dihydroxy-2-methyl-3-(3-methylbut-2-en-1-yl)benzoic acid FIG. 27: Predicted Prenylation Products using DV as substrate and DMAPP as Donor
UNK54
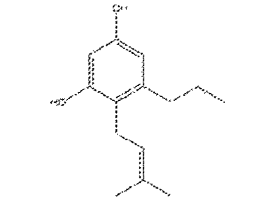
4-(3-methylbut-2-en-1-yl)-5-propylbenzene-1,3-diol
UNK55
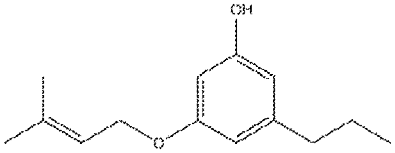
3-((3-methylbut-2-en-1-yl)oxy)-5-propylphenol
UNK56
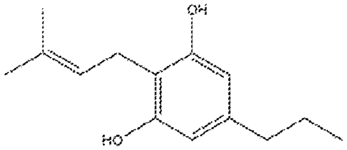
2-(3-methylbut-2-en-1-yl)-5-propylbenzene-1,3-diol
UNK57
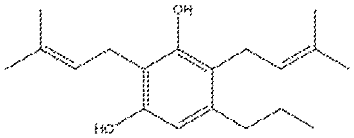
2,4-bis(3-methylbut-2-en-1-yl)-5-propylbenzene-1,3-diol
UNK58
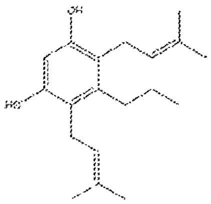
4,6-bis(3-methylbut-2-en-1-yl)-5-propylbenzene-1,3-diol FIG. 28: Predicted Prenylation Products using DV as substrate and GPP as Donor
RBI-32
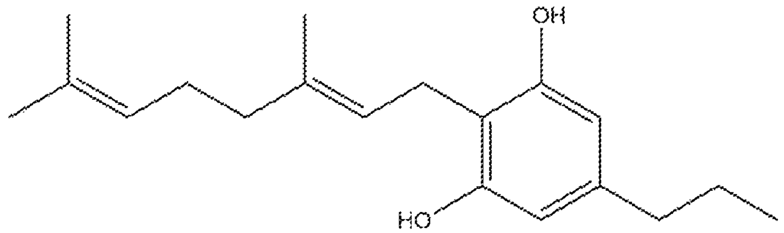
(*E*)-2-(3,7-dimethylocta-2,6-dien-1-yl)-5-propylbenzene-1,3-diol
RBI-33
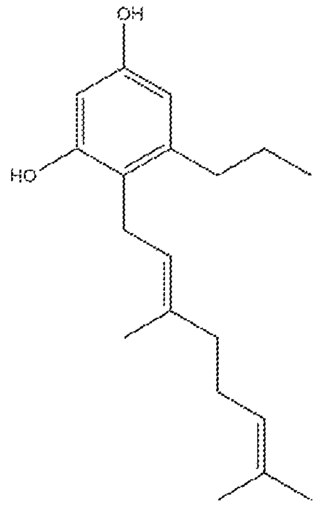
(*E*)-4-(3,7-dimethylocta-2,6-dien-1-yl)-5-propylbenzene-1,3-diol FIG. 29: Predicted Prenylation Products using DVA as substrate and DMAPP as Donor
UNK7
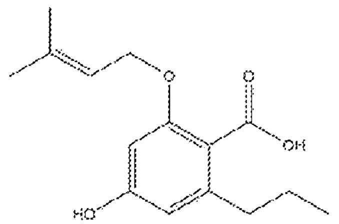
4-hydroxy-2-((3-methylbut-2-en-1-yl)oxy)-6-propylbenzoic acid
UNK8
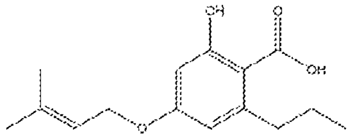
2-hydroxy-4-((3-methylbut-2-en-1-yl)oxy)-6-propylbenzoic acid
UNK9
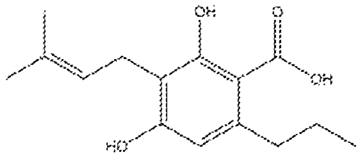
2,4-dihydroxy-3-(3-methylbut-2-en-1-yl)-6-propylbenzoic acid
UNK10
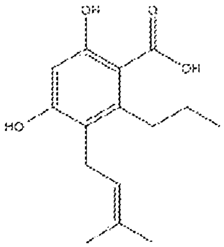
4,6-dihydroxy-3-(3-methylbut-2-en-1-yl)-2-propylbenzoic acid FIG. 30: Predicted Prenylation Products using O as substrate and DMAPP as Donor
RBI-09
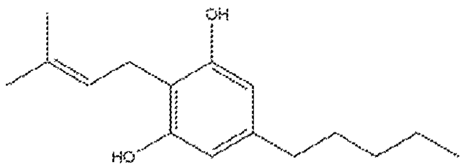
2-(3-methylbut-2-en-1-yl)-5-pentylbenzene-1,3-diol
RBI-10
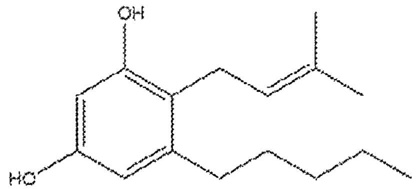
4-(3-methylbut-2-en-1-yl)-5-pentylbenzene-1,3-diol
UNK16
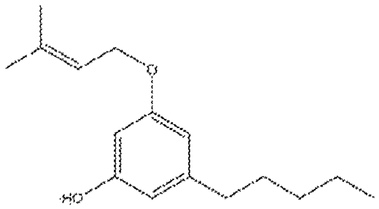
3-((3-methylbut-2-en-1-yl)oxy)-5-pentylphenol
RBI-12
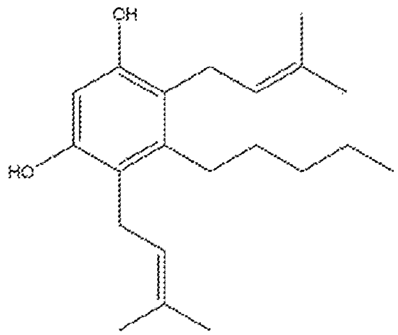
4,6-bis(3-methylbut-2-en-1-yl)-5-pentylbenzene-1,3-diol
RBI-11
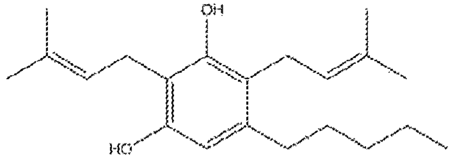
2,4-bis(3-methylbut-2-en-1-yl)-5-pentylbenzene-1,3-diol FIG. 31: Predicted Prenylation Products using CBGA as substrate and DMAPP as Donor
RBI-22
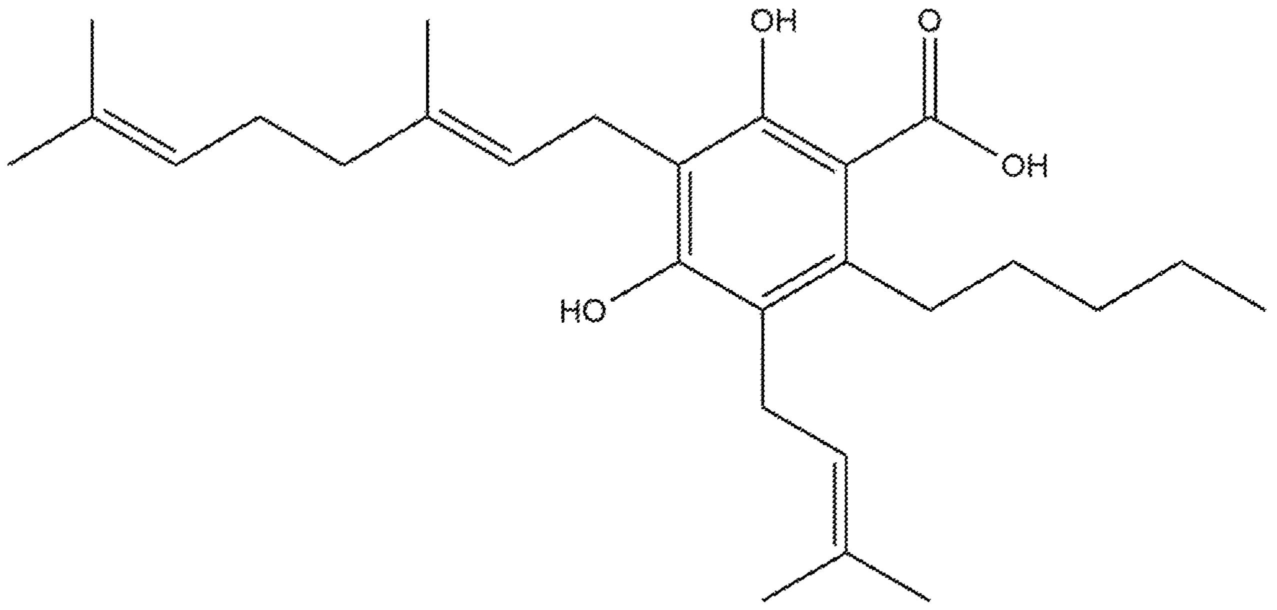
(*E*)-3-(3,7-dimethylocta-2,6-dien-1-yl)-2,4-dihydroxy-5-(3-methylbut-2-en-1-yl)-6-pentylbenzoic acid FIG. 32: Predicted Prenylation Products using RBI-04 as substrate and DMAPP as Donor
UNK36
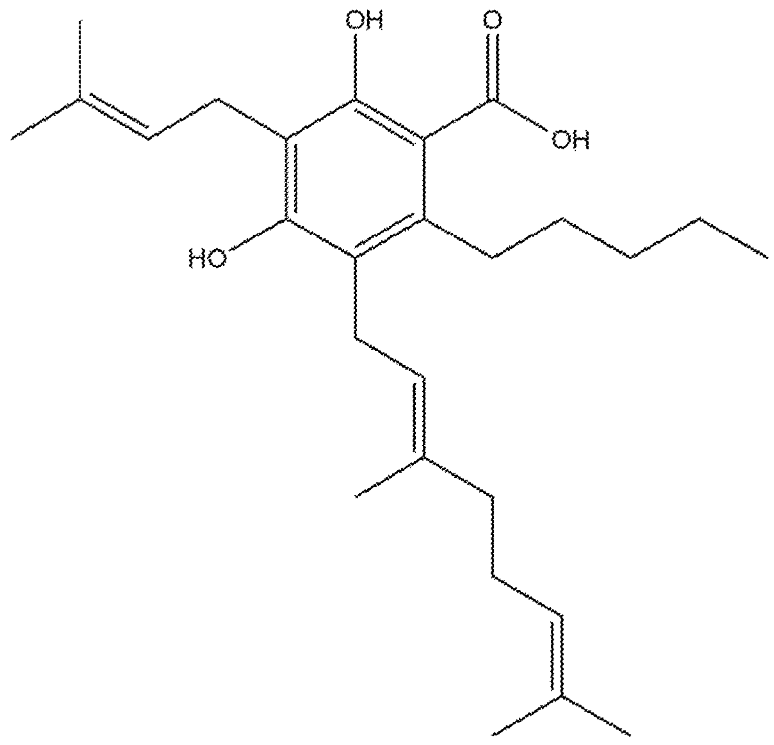
(*E*)-3-(3,7-dimethylocta-2,6-dien-1-yl)-4,6-dihydroxy-5-(3-methylbut-2-en-1-yl)-2-pentylbenzoic acid FIG. 33: Predicted Prenylation Products using RBI-04 as substrate and FPP as Donor
UNK42
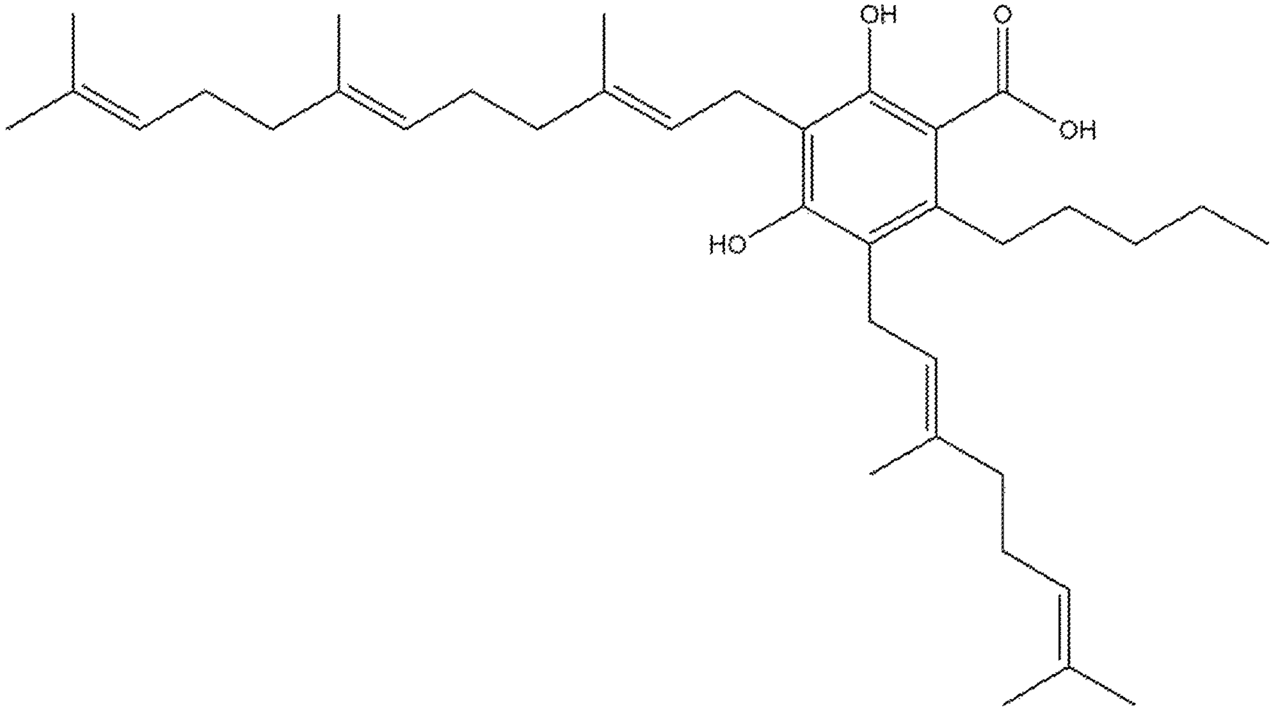
3-((*E*)-3,7-dimethylocta-2,6-dien-1-yl)-4,6-dihydroxy-2-pentyl-5-((2*E*,6*E*)-3,7,11-trimethyldodeca-2,6,10-trien-1-yl)benzoic acid FIG. 34: Predicted Prenylation Products using RBI-04 as substrate and GPP as Donor
RBI-07
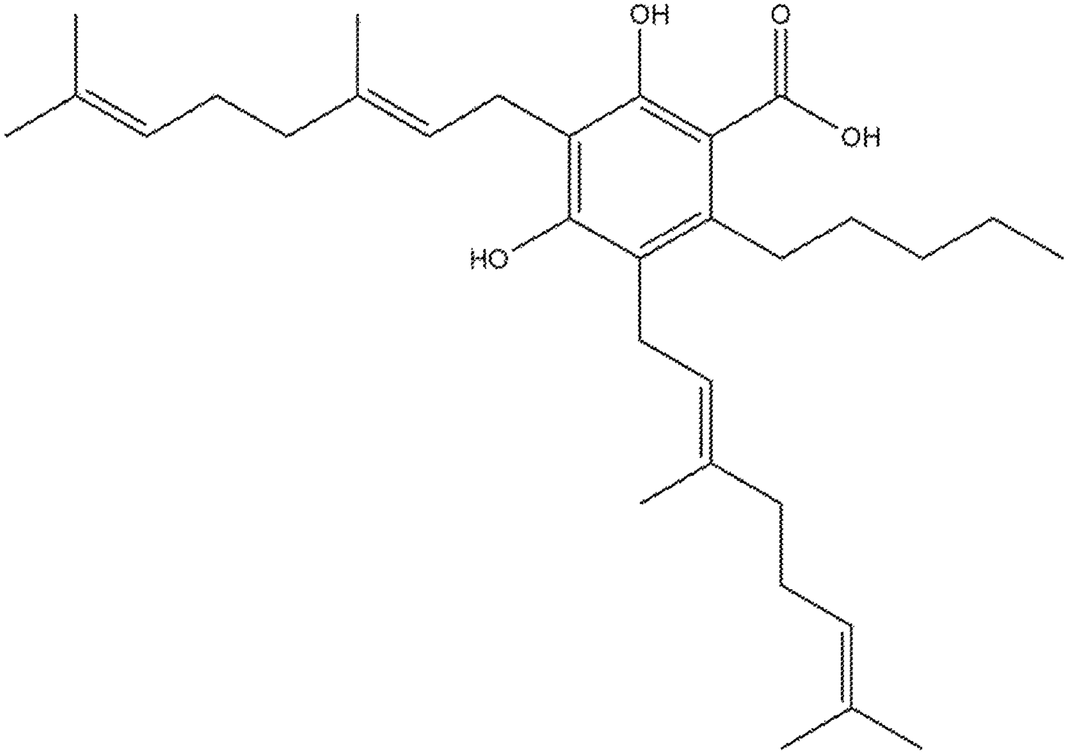
3,5-bis((*E*)-3,7-dimethylocta-2,6-dien-1-yl)-2,4-dihydroxy-6-pentylbenzoic acid FIG. 35: Predicted Prenylation Products using RBI-08 as substrate and DMAPP as Donor
RBI-18
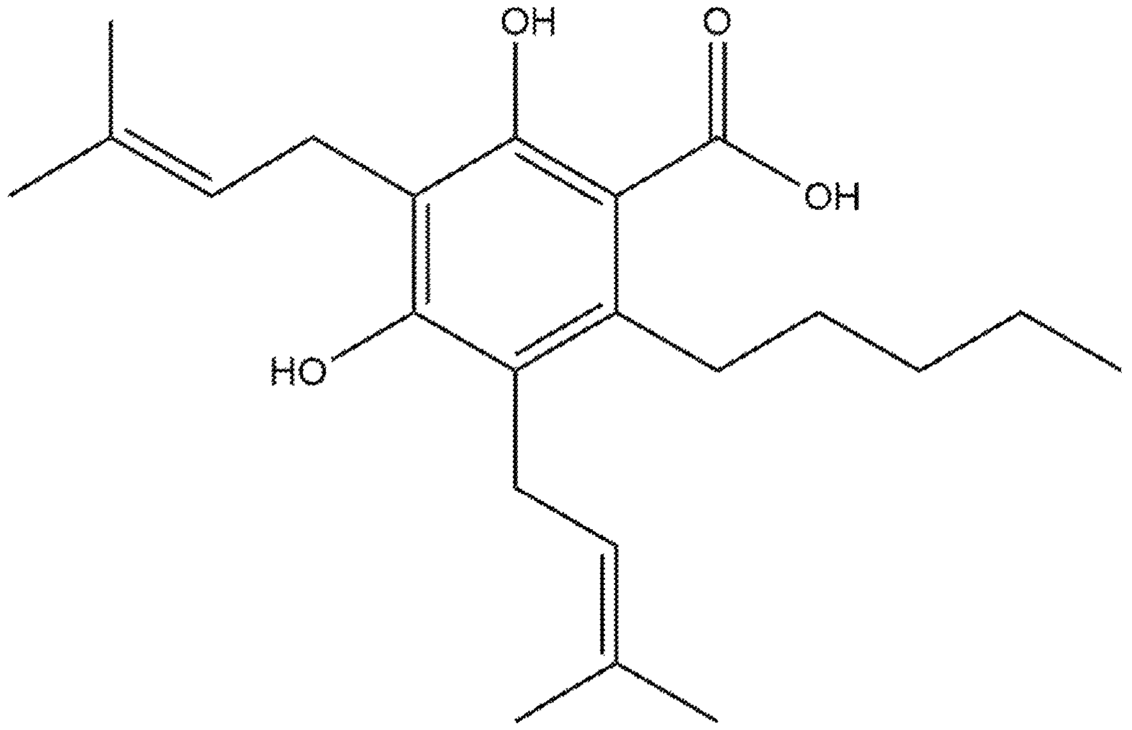
2,4-dihydroxy-3,5-bis(3-methylbut-2-en-1-yl)-6-pentylbenzoic acid FIG. 36: Predicted Prenylation Products using RBI-08 as substrate and GPP as Donor
UNK36
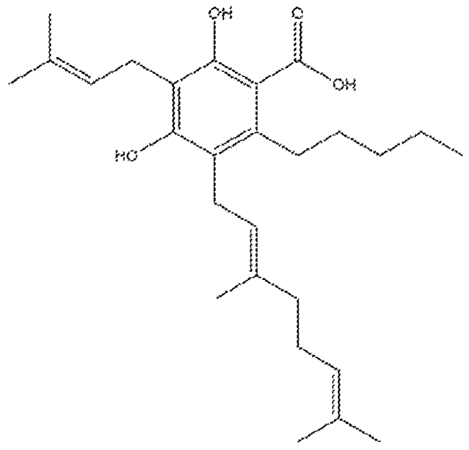
(E)-3-(3,7-dimethylocta-2,6-dien-1-yl)-4,6-dihydroxy-5-(3-methylbut-2-en-1-yl)-2-pentylbenzoic acid
UNK38
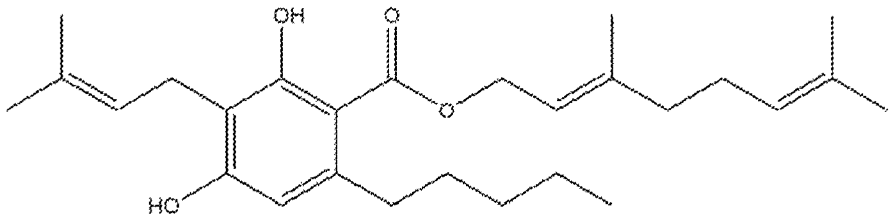
(E)-3,7-dimethylocta-2,6-dien-1-yl 2,4-dihydroxy-3-(3-methylbut-2-en-1-yl)-6-pentylbenzoate FIG. 37: Predicted Prenylation Products using RBI-09 as substrate and GPP as Donor
UNK40
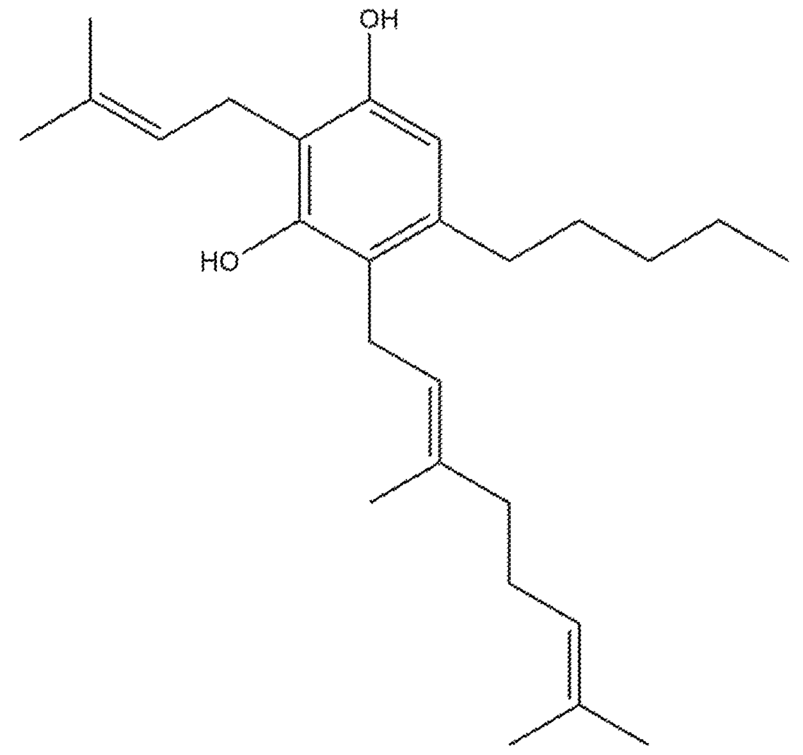
(*E*)-4-(3,7-dimethylocta-2,6-dien-1-yl)-2-(3-methylbut-2-en-1-yl)-5-pentylbenzene-1,3-diol FIG. 38: Predicted Prenylation Products using RBI-10 as substrate and DMAPP as Donor
RBI-11
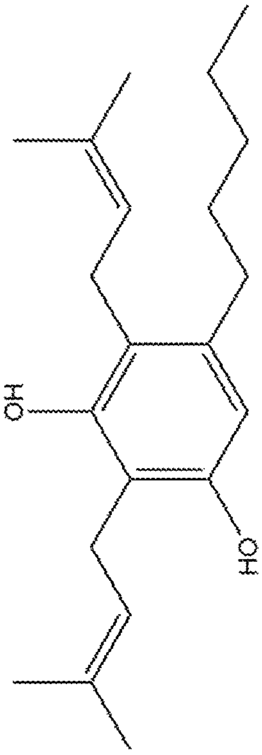
2,4-bis(3-methylbut-2-en-1-yl)-5-pentylbenzene-1,3-diol
RBI-12
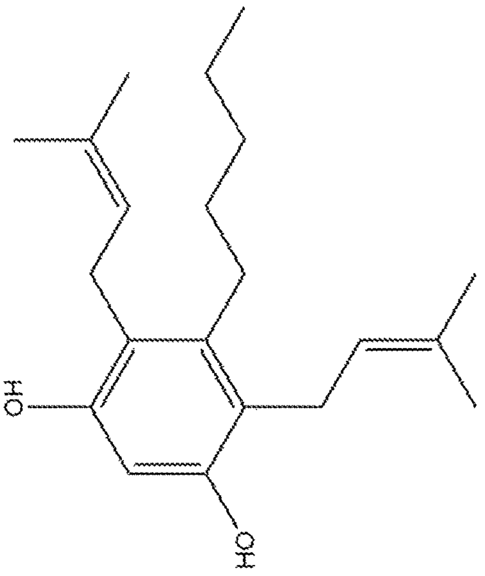
4,6-bis(3-methylbut-2-en-1-yl)-5-pentylbenzene-1,3-diol FIG. 39: Predicted Prenylation Products using RBI-10 as substrate and FPP as Donor
UNK34
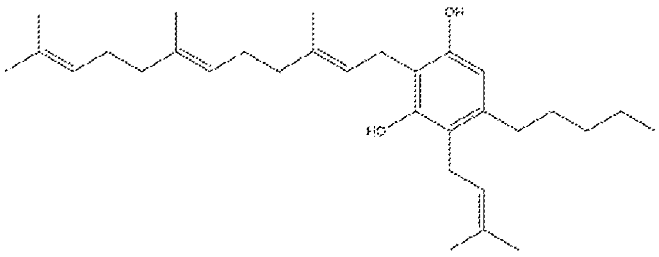
4-(3-methylbut-2-en-1-yl)-5-pentyl-2-((2E,6E)-3,7,11-trimethyldodeca-2,6,10-trien-1-yl)benzene-1,3-diol
UNK45
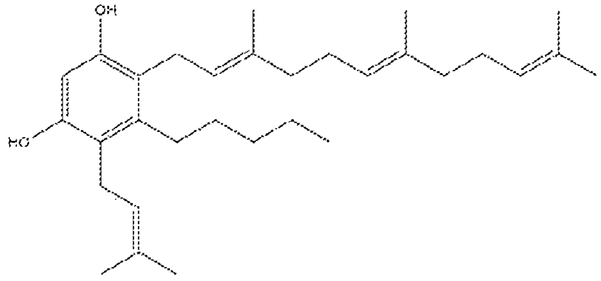
4-(3-methylbut-2-en-1-yl)-5-pentyl-6-((2E,6E)-3,7,11-trimethyldodeca-2,6,10-trien-1-yl)benzene-1,3-diol FIG. 40: Predicted Prenylation Products using RBI-10 as substrate and GPP as Donor
UNK41
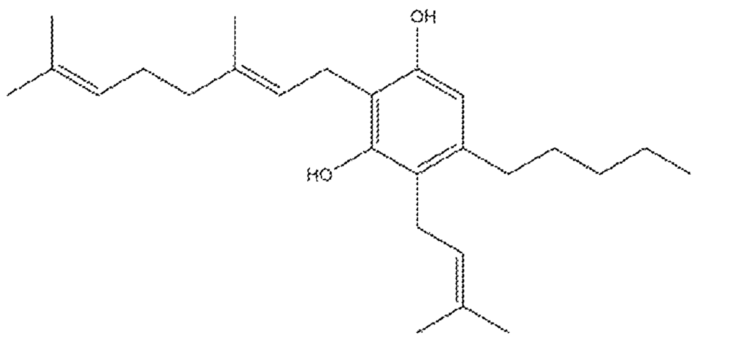
(*E*)-2-(3,7-dimethylocta-2,6-dien-1-yl)-4-(3-methylbut-2-en-1-yl)-5-pentylbenzene-1,3-diol
UNK66
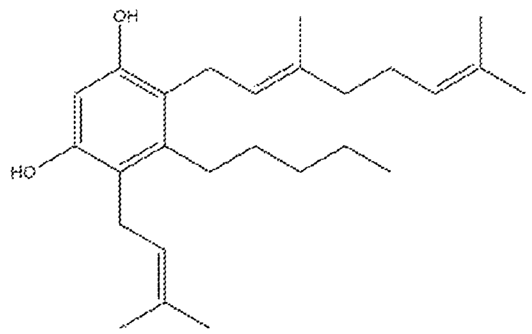
(*E*)-4-(3,7-dimethylocta-2,6-dien-1-yl)-6-(3-methylbut-2-en-1-yl)-5-pentylbenzene-1,3-diol FIG. 41: Predicted Prenylation Products using RBI-12 as substrate and GPP as Donor
UNK67
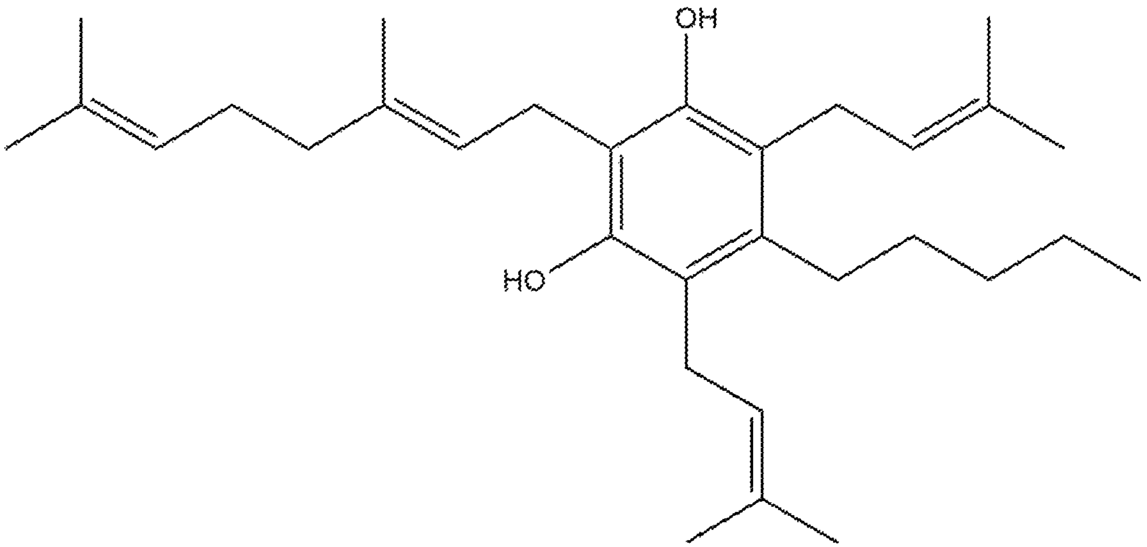
(*E*)-2-(3,7-dimethylocta-2,6-dien-1-yl)-4,6-bis(3-methylbut-2-en-1-yl)-5-pentylbenzene-1,3-diol FIG. 42: Predicted Prenylation Products using RBI-03 as substrate and DMAPP as Donor
UNK40
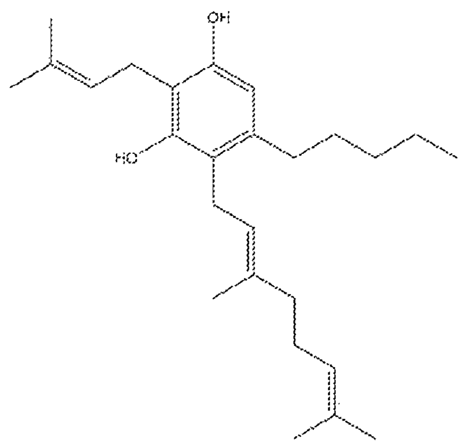
(E)-4-(3,7-dimethylocta-2,6-dien-1-yl)-2-(3-methylbut-2-en-1-yl)-5-pentylbenzene-1,3-diol
UNK66
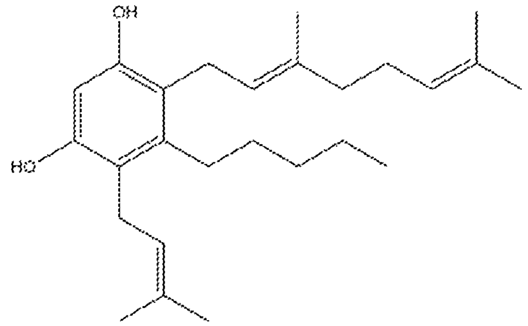
(E)-4-(3,7-dimethylocta-2,6-dien-1-yl)-6-(3-methylbut-2-en-1-yl)-5-pentylbenzene-1,3-diol FIG. 43: Predicted Prenylation Products using O as substrate and FPP as Donor
RBI-15
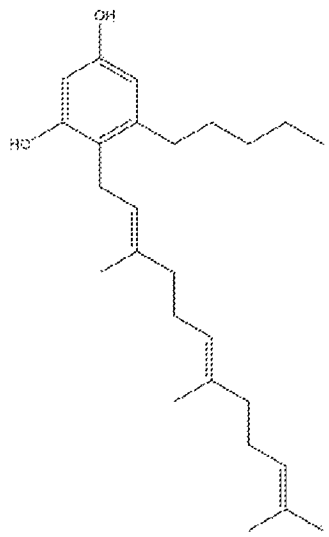
5-pentyl-4-((2E,6E)-3,7,11-trimethyldodeca-2,6,10-trien-1-yl)benzene-1,3-diol
UNK18
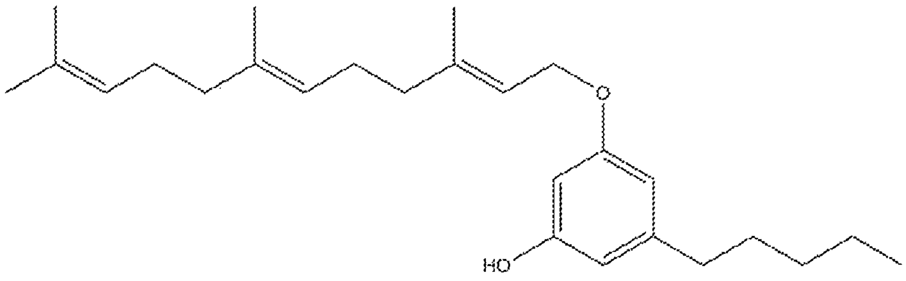
3-pentyl-5-(((2E,6E)-3,7,11-trimethyldodeca-2,6,10-trien-1-yl)oxy)phenol
UNK19
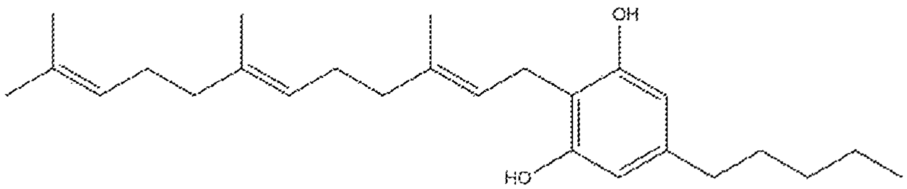
5-pentyl-2-((2E,6E)-3,7,11-trimethyldodeca-2,6,10-trien-1-yl)benzene-1,3-diol FIG. 44: Predicted Prenylation Products using ORA as substrate and FPP as Donor
UNK33
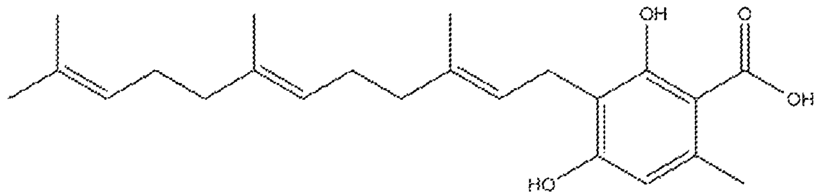
2,4-dihydroxy-6-methyl-3-((2*E*,6*E*)-3,7,11-trimethyldodeca-2,6,10-trien-1-yl)benzoic acid
UNK34
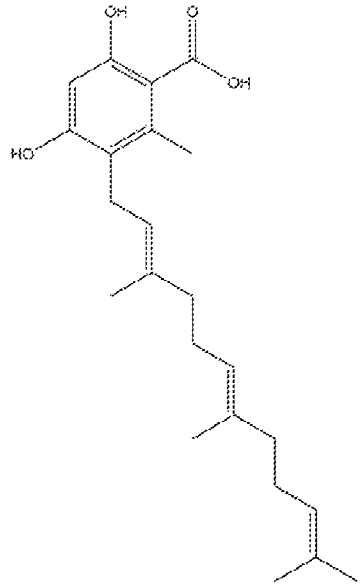
4,6-dihydroxy-2-methyl-3-((2*E*,6*E*)-3,7,11-trimethyldodeca-2,6,10-trien-1-yl)benzoic acid
UNK31
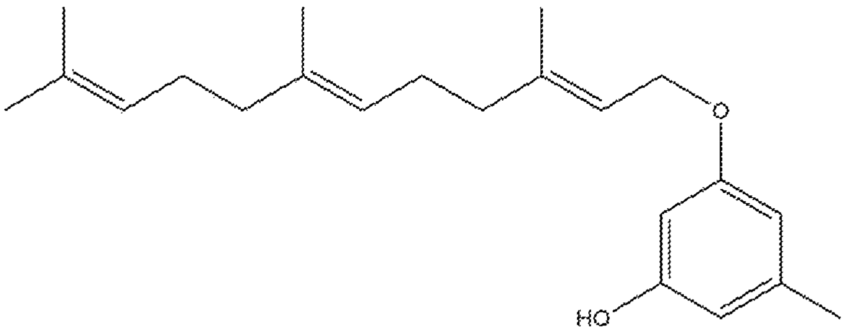
3-methyl-5-(((2*E*,6*E*)-3,7,11-trimethyldodeca-2,6,10-trien-1-yl)oxy)phenol FIG. 45: Predicted Prenylation Products using OA as substrate and GGPP as Donor
UNK60
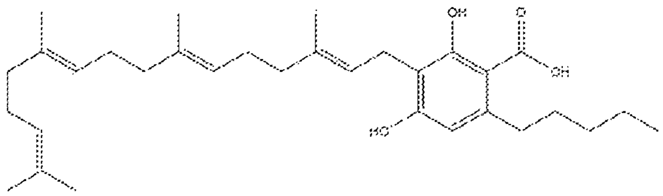
2,4-dihydroxy-6-pentyl-3-((2E,6E,10E)-3,7,11,15-tetramethylhexadeca-2,6,10,14-tetraen-1-yl)benzoic acid
UNK61
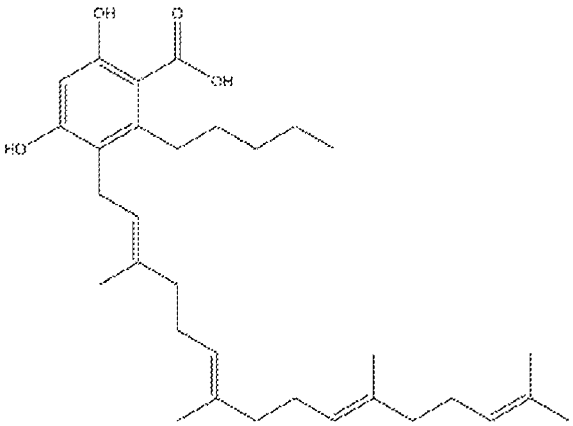
4,6-dihydroxy-2-pentyl-3-((2E,6E,10E)-3,7,11,15-tetramethylhexadeca-2,6,10,14-tetraen-1-yl)benzoic acid FIG. 46: Predicted Prenylation Products using ORA as substrate and GGPP as Donor
UNK62
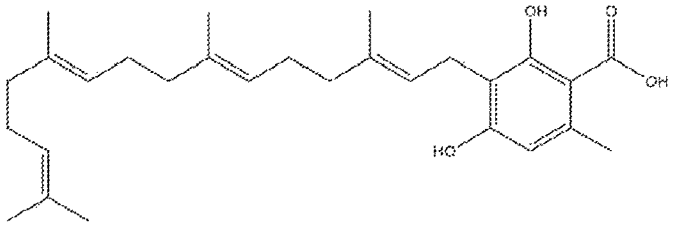
2,4-dihydroxy-6-methyl-3-((2E,6E,10E)-3,7,11,15-tetramethylhexadeca-2,6,10,14-tetraen-1-yl)benzoic acid
UNK63
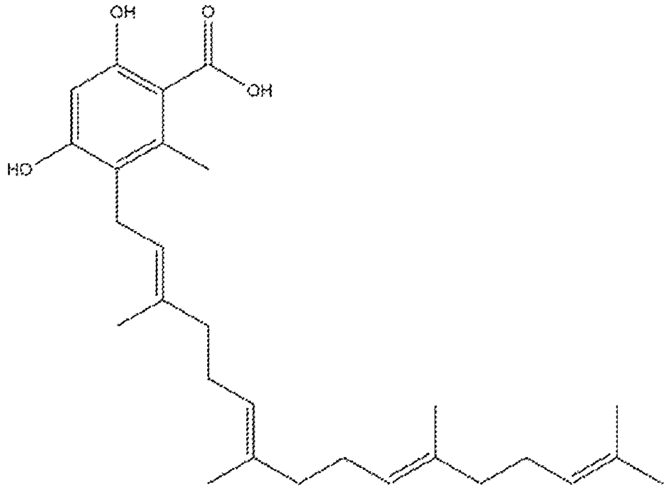
4,6-dihydroxy-2-methyl-3-((2E,6E,10E)-3,7,11,15-tetramethylhexadeca-2,6,10,14-tetraen-1-yl)benzoic acid FIG. 47: Predicted Prenylation Products using DVA as substrate and GGPP as Donor
UNK64
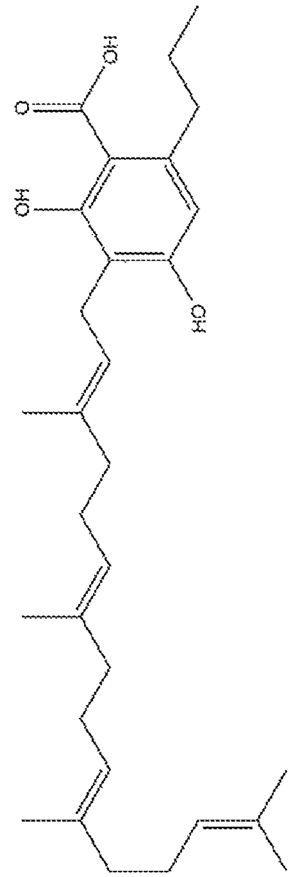
2,4-dihydroxy-6-propyl-3-((2E,6E,10E)-3,7,11,15-tetramethylhexadeca-2,6,10,14-tetraen-1-yl)benzoic acid
UNK65
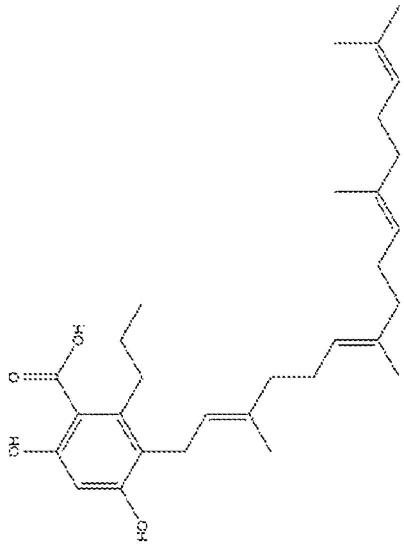
4,6-dihydroxy-2-propyl-3-((2E,6E,10E)-3,7,11,15-tetramethylhexadeca-2,6,10,14-tetraen-1-yl)benzoic acid FIG. 48: Alkylresorcinol (i.e. DV, O, etc) prenylation site numbering
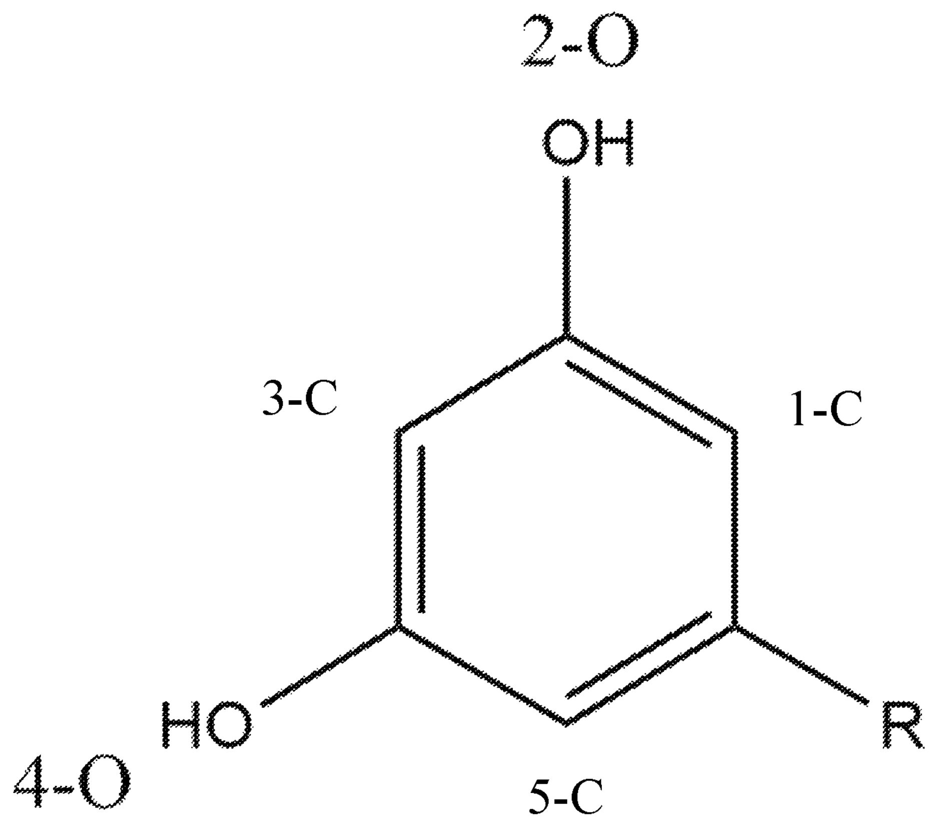

FIG. 49: Alkylresorcyclic Acid (i.e. ORA, DVA, OA, etc) prenylation site numbering
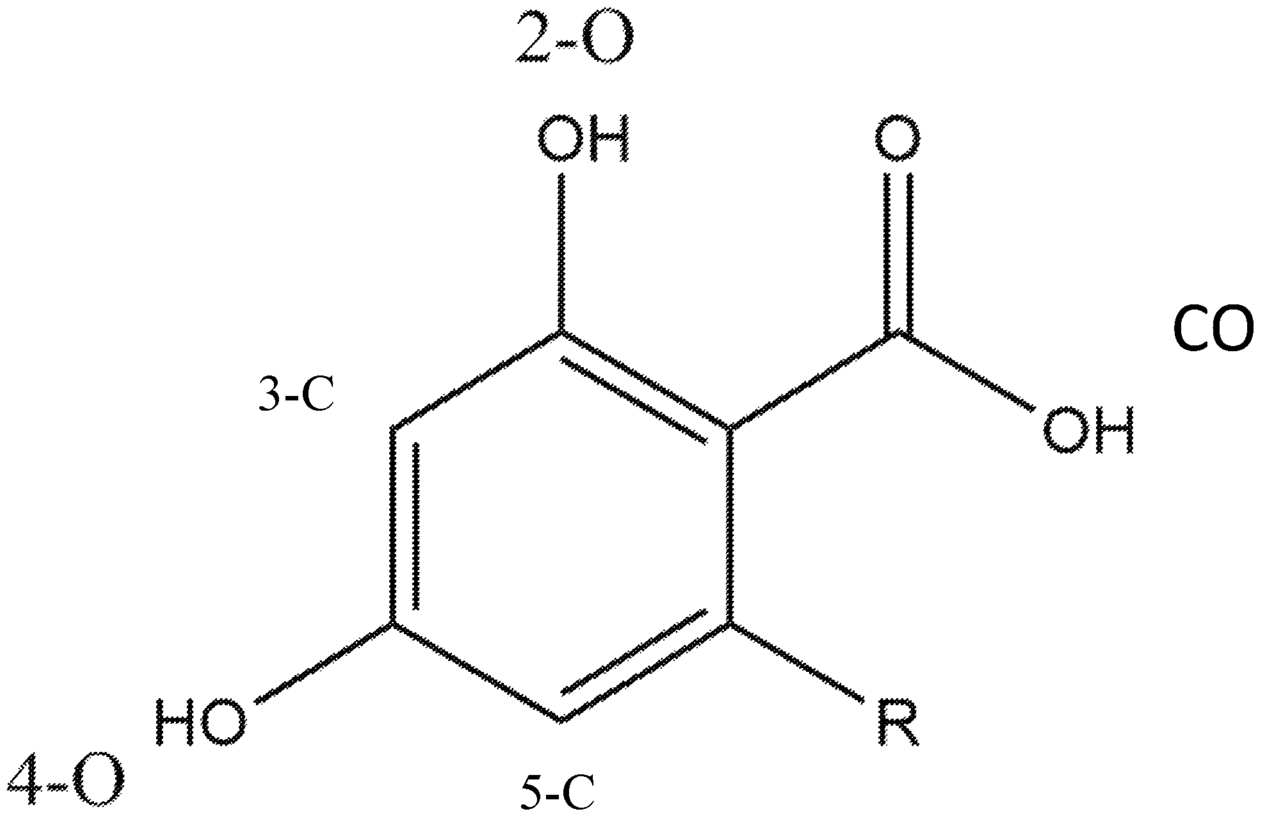

FIG. 50: Apigenin prenylation site numbering
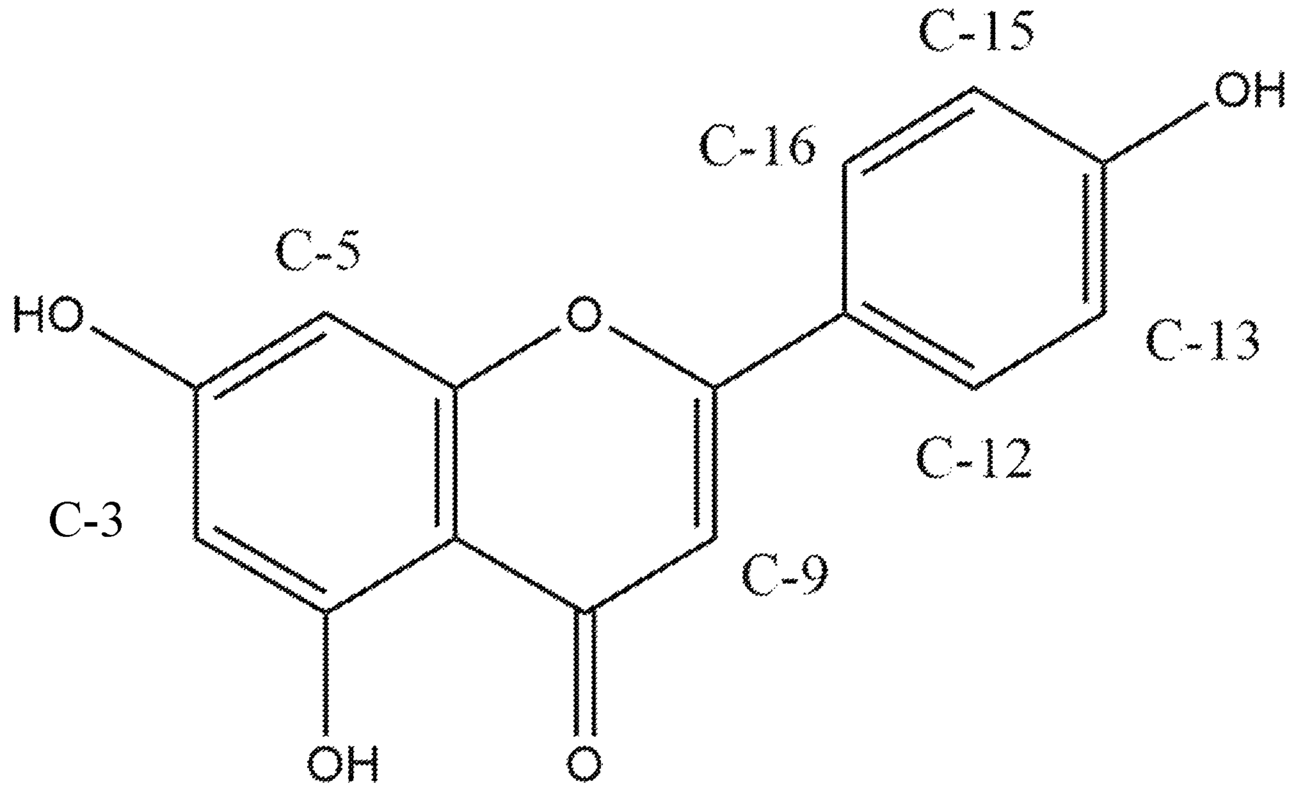

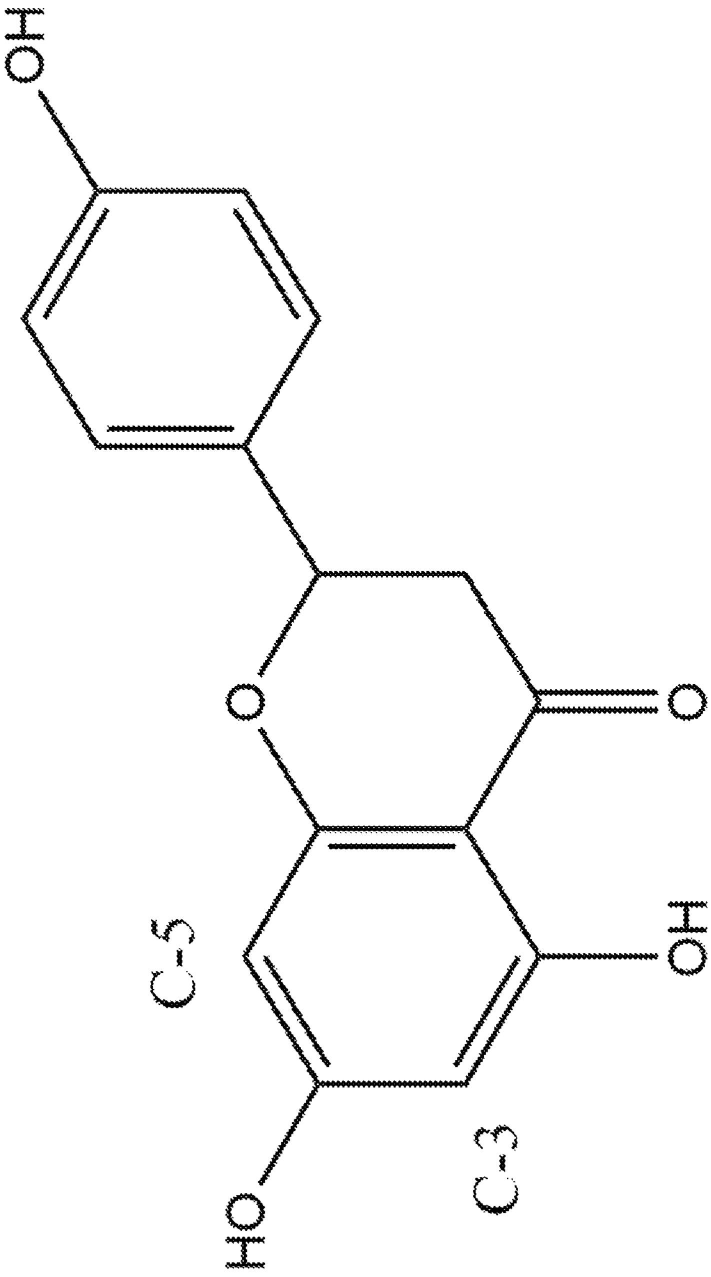
FIG. 51: Naringenin prenylation site numbering

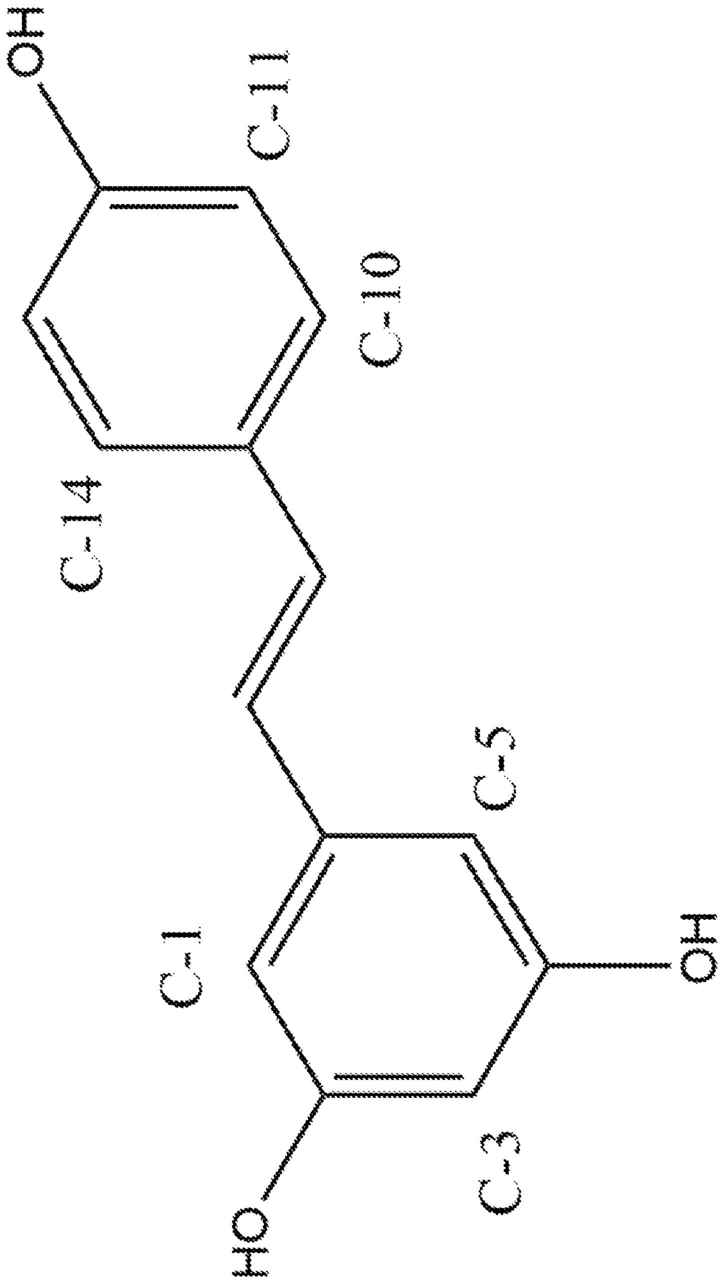
FIG. 52: Reservatrol prenylation site numbering

Total nMol of prenylated products produced by ORF2 triple mutants using OA as substrate and FPP as donor % CBFA produced by ORF2 triple mutants using OA as substrate and FPP as donor % enzymatic activity of ORF2 triple mutants using OA as substrate and FPP as donor CBFA production potential of ORF2 triple mutants using OA as substrate and FPP as donor FIG. 57: Cluster map of ORF2 triple mutants clustered based on CBFA production potential and %5-FOA produced, using OA as substrate and FPP as donor
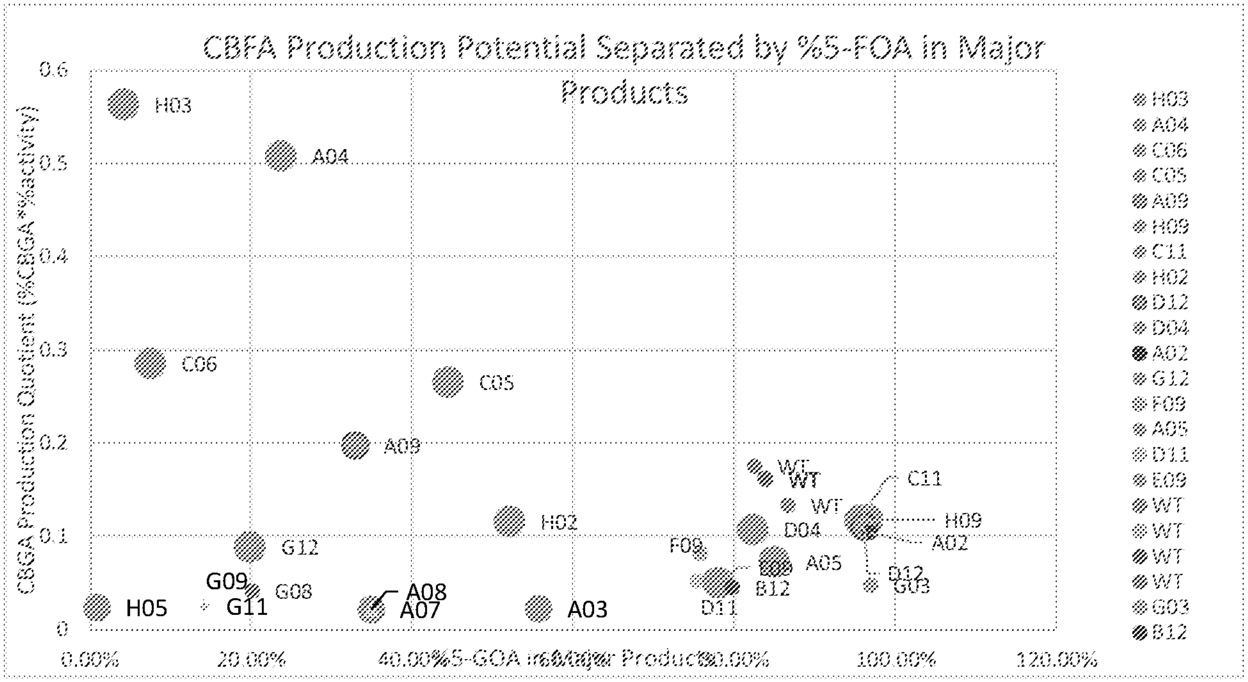

FIG. 58: Analysis of ORF-2 enzymatic function of mutants derived from the breakdown of ORF-2 triple mutant clone A04

FIG. 59
Analysis of ORF-2 enzymatic function of mutants derived from the breakdown of ORF-2 triple mutant clone C05
FIG. 59A
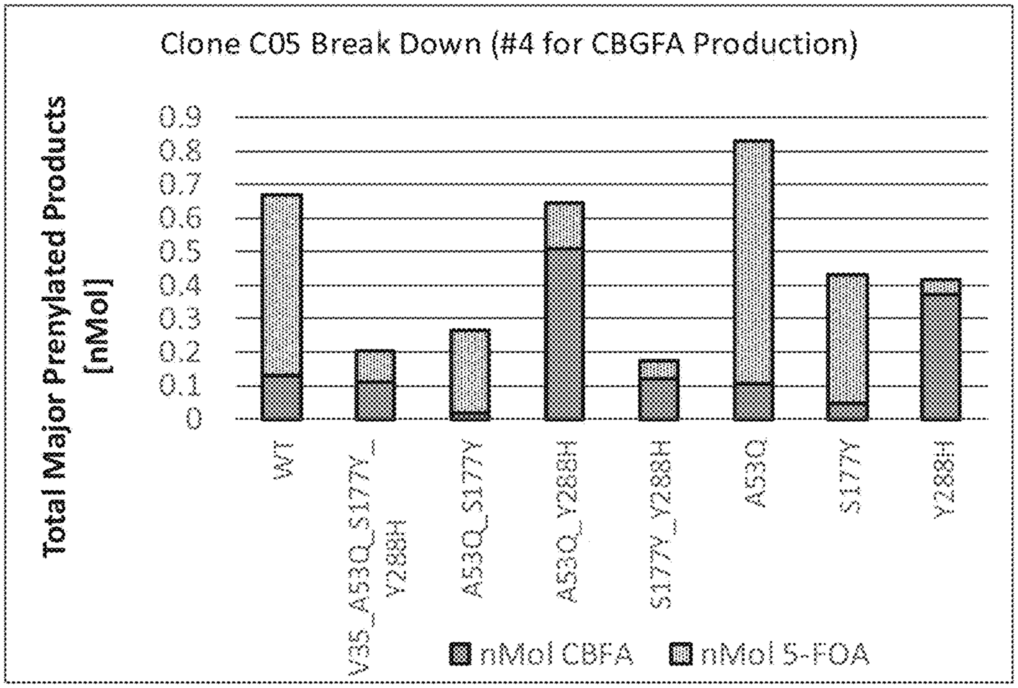
FIG. 59B
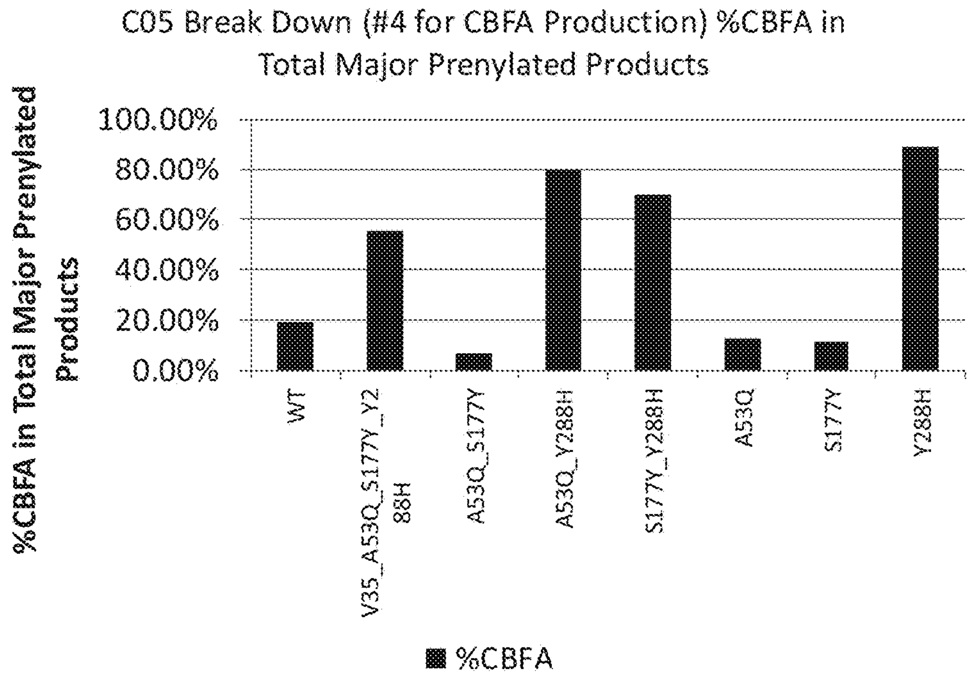

FIG. 60: Analysis of ORF-2 enzymatic function of mutants derived from the breakdown of ORF-2 triple mutant clone A09

FIG. 61: Analysis of ORF-2 enzymatic function of mutants derived from the breakdown of ORF-2 triple mutant H02

FIG. 62: Analysis of ORF-2 enzymatic function of mutants derived from the breakdown of ORF-2 triple mutant clone D04

FIG. 63: Analysis of ORF-2 enzymatic function of mutants derived from the breakdown of ORF-2 triple mutant clone F09

FIG. 64: Analysis of ORF-2 enzymatic function of mutants derived from the breakdown of ORF-2 triple mutant clone D11

FIG. 65: Analysis of ORF-2 enzymatic function of mutants derived from the breakdown of ORF-2 triple mutant clone E09

FIG. 66: Analysis of enzymatic activity of site-saturated ORF2 mutants of Q295 using OA as substrate and FPP as donor FIG. 66C: 5-FOA production (using OA as substrate and FPP as donor) by ORF2 mutants carrying site saturation Q295 mutations
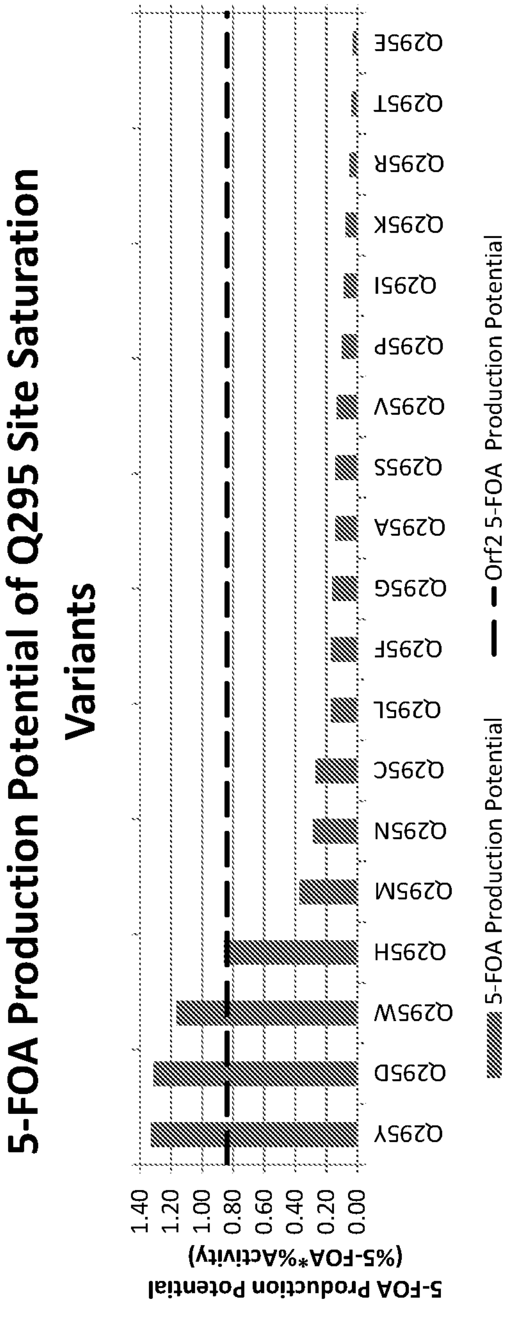

FIG. 67: Analysis of enzymatic activity of site-saturated ORF2 mutants of Q161 using OA as substrate and FPP as donor FIG. 67C: 5-GOA production (using OA as substrate and FPP as donor) by ORF2 mutants carrying site saturation Q161 mutations
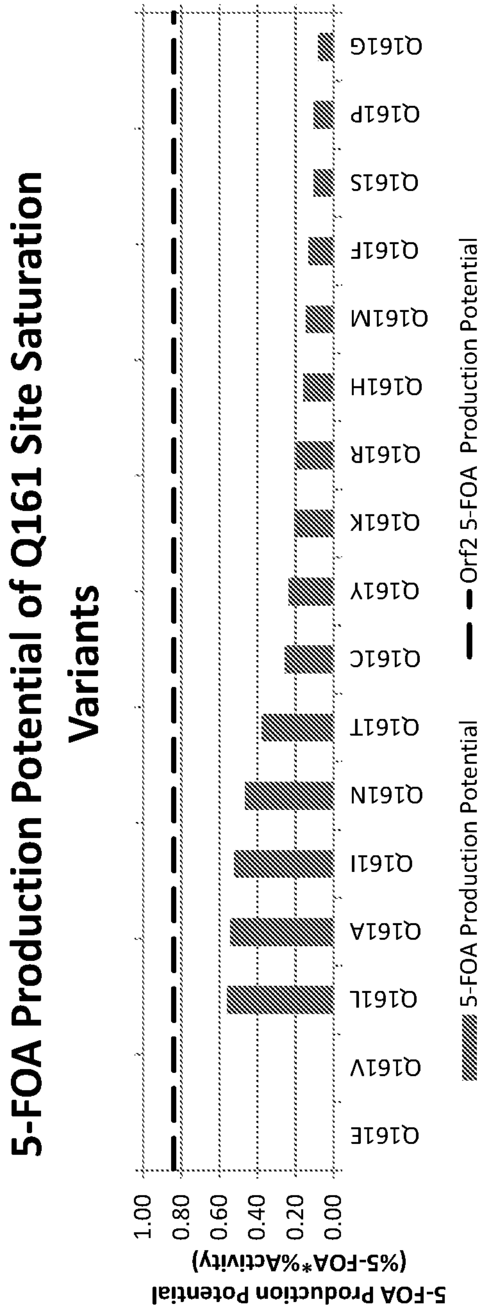

FIG. 68: Analysis of enzymatic activity of site-saturated ORF2 mutants of S214 using OA as substrate and FPP as donor FIG. 68C: 5-GOA production (using OA as substrate and FPP as donor) by ORF2 mutants carrying site saturation S214 mutations
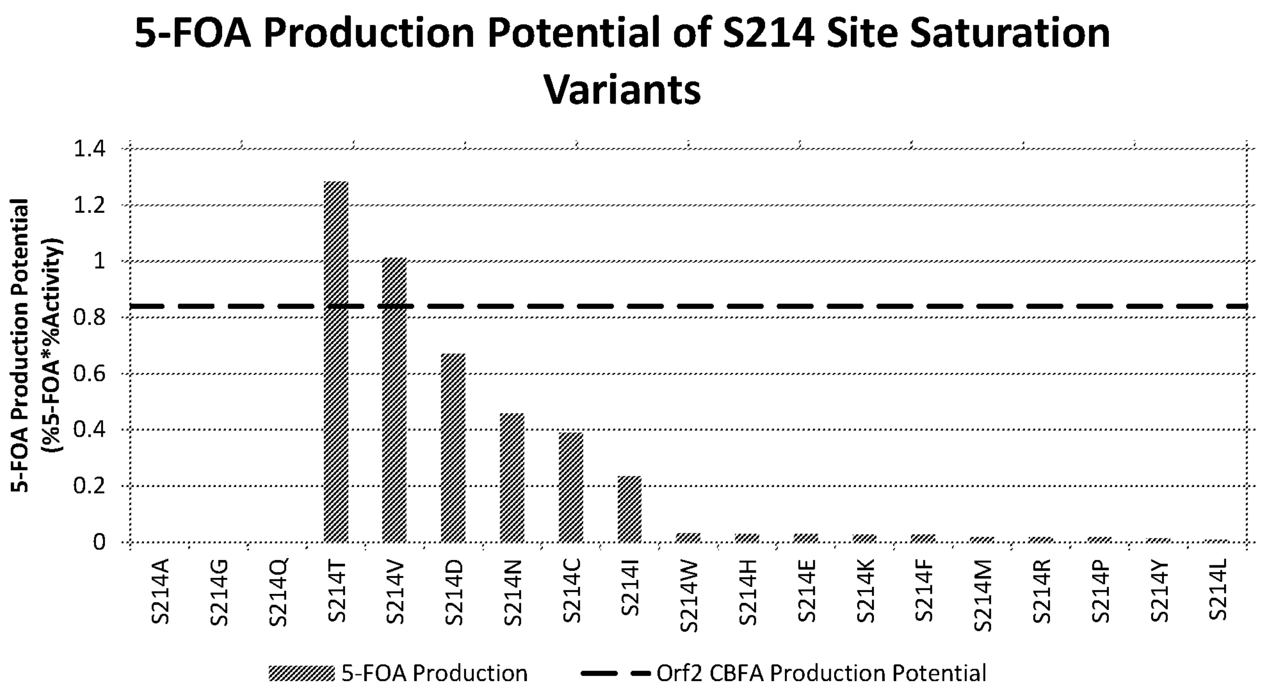

ORF-2 activity (using OA as substrate and FPP as donor) of S214R-Q295F Stacking variant ORF-2 activity (using OA as substrate and FPP as donor) of S177W-Q295A Stacking variant ORF-2 activity (using OA as substrate and FPP as donor) of A53T-Q295F Stacking variant ORF-2 activity (using OA as substrate and FPP as donor) of Q161S-Q295L Stacking variant Total nMol of prenylated products produced by ORF2 triple mutants using OA as substrate and DMAPP as donor % 3-DOA and %5-DOA produced by ORF2 triple mutants using OA as substrate and DMAPP as donor % enzymatic activity of ORF2 triple mutants using OA as substrate and DMAPP as donor 3-DOA production potential of ORF2 triple mutants using OA as substrate and DMAPP as donor Cluster map of ORF2 triple mutants clustered based on 3-DOA production potential and %5-DOA produced, using OA as substrate and DMAPP as donor FIG. 78: Complete amino acid replacement at position Q161 and S214 in Orf2 allows a structure function mechanism for CBGA production and regiospecific prenylation FIG. 79: Complete amino acid replacement at position Q295 in Orf2 allows a structure function mechanism for CBGA production and regiospecific prenylation

Q295

Carbon and Proton NMR Assignments for CBGVA

Protons: 28
Carbons: 20

Carbon and Proton NMR Assignments for RBI-29

Protons: 44
Carbons: 30

Carbon and Proton NMR Assignments for UNK59

Protons: 40
Carbons: 28

Carbon and Proton NMR Assignments for CBG

Protons: 32
Carbons: 21

| RBI-01 | |
|---|---|
| Proton | Shift |
| C1b | 3.344 |
| C2b | 5.28 |
| C7b | 1.823 |
| C4b | 2.11 |
| C5b | 2.083 |
| C6b | 5.062 |
| C9b | 1.688 |
| C10b | 1.601 |
| 2' OH | 7.274 |
| C5'+C1' | 6.261 |
| C1'' | 2.78 |
| C2'' | 1.575 |
| C3''+C4'' | 1.322 |
| C5'' | 0.895 |

| RBI-02 | |
|---|---|
| Proton | Shift |
| C1b | 3.443 |
| C2b | 5.292 |
| C7b | 1.827 |
| C4b | 2.117 |
| C5b | 2.092 |
| C6b | 5.066 |
| C9b | 1.688 |
| C10b | 1.605 |
| 2' OH | 7.272 |
| C5' | 6.261 |
| C1'' | 2.885 |
| C2'' | 1.585 |
| C3''+C4'' | 1.353 |
| C5'' | 0.909 |

| RBI-03 | |
|---|---|
| Proton | Shift |
| C1a | 3.3 |
| C2a | 5.152 |
| C7a | 1.816 |
| C4a | 2.099 |
| C5a | 2.068 |
| C6a | 5.055 |
| C9a | 1.684 |
| C10a | 1.6 |
| C3' | 6.266 |
| C1' | 6.234 |
| C1'' | 2.541 |
| C2'' | 1.533 |
| C3''+C4'' | 1.343 |
| C5'' | 0.909 |

| RBI-04 | |
|---|---|
| Proton | Shift |
| C1a | 3.348 |
| C2a | 5.152 |
| C7a | 1.814 |
| C4a | 2.099 |
| C5a | 2.064 |
| C6a | 5.055 |
| C9a | 1.679 |
| C10a | 1.601 |
| C3' | 6.343 |
| C1'' | 2.959 |
| C2'' | 1.555 |
| C3''+C4'' | 1.391 |
| C5'' | 0.927 |

| RBI-05 | |
|---|---|
| Proton | Shift |
| C5'' | 0.891 |
| C3''+C4'' | 1.348 |
| C10c | 1.611 |
| C9c | 1.687 |
| C7c | 1.747 |
| C5c+C4c | 2.108 |
| C1'' | 2.929 |
| C1c | 4.651 |
| C6c | 5.076 |
| C2c | 5.499 |
| C5'+C3' | 6.387 |
| C2'' | 1.57 |

| RBI-07 | |
|---|---|
| Proton | Shift |
| C5'' | 0.919 |
| C3''+C4'' | 1.268 |
| C10a+C10b | 1.601 |
| C9a+C9b | 1.681 |
| C7a | 1.796 |
| C7b | 1.828 |
| C5ab+C4ab | 2.02-2.1 |
| C1a | 3.353 |
| C1b | 3.454 |
| C2a+C6b+C6a | 5.069 |
| C2b | 5.263 |
| COOH | 11.801 |
| C1'' | 2.911 |
| C2'' | 1.571 |

| RBI-08 | |
|---|---|
| Proton | Shift |
| C1a | 3.424 |
| C2a | 5.283 |
| C4a | 1.836 |
| C5a | 1.772 |
| C1'' | 2.874 |
| C2'' | 1.57 |
| C3''+C4'' | 1.345 |
| C5'' | 0.904 |
| C5' | 6.274 |
| COOH | 12.022 |
| C6'OH | 5.845 |

| RBI-09 | |
|---|---|
| Proton | Shift |
| C1a | 3.386 |
| C1" | 2.463 |
| C2a | 5.276 |
| C2" | 1.573 |
| C3"+C4" | 1.32 |
| C1'+C5' | 6.257 |
| C4a | 1.834 |
| C5" | 0.896 |
| C5a | 1.767 |

| RBI-10 | |
|---|---|
| Proton | Shift |
| C1b | 3.282 |
| C3' | 6.219 |
| C1" | 2.524 |
| C2b | 5.139 |
| C2" | 1.52 |
| C3"+C4" | 1.33 |
| C4b | 1.813 |
| C5b | 1.74 |
| C5' | 6.256 |
| C5" | 0.896 |

| RBI-11 | |
|---|---|
| Proton | Shift |
| C1a | 3.382 |
| C1b | 3.293 |
| C1" | 2.504 |
| C2b | 5.125 |
| C2" | 1.506 |
| C3"+C4" | 1.342 |
| C4a+C4b | 1.819 |
| C5a+C5b | 1.744 |
| C5' | 6.257 |
| C5" | 0.896 |

| RBI-12 | |
|---|---|
| Proton | Shift |
| C1b+C1b | 3.285 |
| C1" | 2.553 |
| C2b+C2b | 5.119 |
| C2" | 1.551 |
| C3"+C4" | 1.355 |
| C4b+C4b | 1.798 |
| C5b+C5b | 1.715 |
| C3' | 6.235 |
| C5" | 0.896 |

COMPOSITIONS AND METHODS FOR USING GENETICALLY MODIFIED ENZYMES

CROSS-REFERENCE

This application claims the benefit of U.S. Provisional Application No. 62/833,449, filed Apr. 12, 2019, which application is incorporated herein by reference in its entirety.

TECHNICAL FIELD

The present disclosure is generally related to the biosynthesis of organic compounds, such as cannabinoids, using recombinant enzymes, such as recombinant aromatic prenyltransferases.

INCORPORATION BY REFERENCE OF SEQUENCE LISTING

The contents of the text file named "REBI_002_00US_SeqList_ST25.txt", which was created on Apr. 12, 2019 and is 1190000 bytes in size, are hereby incorporated by reference in its entirety.

BACKGROUND

Cannabinoids include a group of more than 100 chemical compounds mainly found in the plant *Cannabis sativa* L. Due to the unique interaction of cannabinoids with the human endocannabinoid system, many of these compounds are potential therapeutic agents for the treatment of several medical conditions. For instance, the psychoactive compound $\Delta^9$-tetrahydrocannabinol ($\Delta^9$-THC) has been used in the treatment of pain and other medical conditions. Several synthetic *Cannabis*-based preparations have been used in the USA, Canada and other countries as an authorized treatment for nausea and vomiting in cancer chemotherapy, appetite loss in acquired immune deficiency syndrome and symptomatic relief of neuropathic pain in multiple sclerosis.

Cannabinoids are terpenophenolic compounds, produced from fatty acids and isoprenoid precursors as part of the secondary metabolism of *Cannabis*. The main cannabinoids produced by *Cannabis* are $\Delta^9$-tetrahydrocannabidiol (THC), cannabidiol (CBD) and cannabinol (CBN), followed by cannabigerol (CBG), cannabichromene (CBC) and other minor constituents. Currently, $\Delta^9$-THC and CBD are either extracted from the plant or chemically synthesized. However, agricultural production of cannabinoids faces challenges such as plant susceptibility to climate and diseases, low content of less-abundant cannabinoids, and need for extraction of cannabinoids by chemical processing. Furthermore, chemical synthesis of cannabinoids has failed to be a cost-effective alternative mainly because of complex synthesis leading to high production cost and low yields.

Therefore, there is a pressing need for biotechnology-based synthetic biology approaches which can enable the synthesis of high-quality cannabinoids in a cost-effective and environmentally friendly manner. Further, there is also a need for the synthesis of a diverse group of chemical compounds including not limited to cannabinoids using similar synthetic biology approaches.

SUMMARY

The disclosure provides recombinant polypeptides comprising an amino acid sequence with at least 80% identity to the amino acid sequence of a prenyltransferase, wherein the recombinant polypeptide comprises at least one amino acid substitution compared to the amino acid sequence of the prenyltransferase, wherein said recombinant polypeptide converts a substrate and a prenyl donor to at least one prenylated product, and wherein the recombinant polypeptide produces a ratio of an amount of the at least one prenylated product to an amount of total prenylated products that is higher than the prenyltransferase under the same condition.

In some aspects, the recombinant polypeptide comprises an amino acid sequence with at least 95% identity to the amino acid sequence of the prenyltransferase. In some aspects, the amino acid sequence has at least 96%, 97%, 98%, or 99% sequence identity to the amino acid sequence of the prenyltransferase. In some aspects, the at least one amino acid substitution comprises 1, 2, 3, 4, 5, 6, 7, 8, 9, 10, 11, 12, 13, 14, or 15 amino acid substitutions to the amino acid sequence of the prenyltransferase.

In some aspects, the prenyltransferase is selected from the group consisting of ORF2, HypSc, PB002, PB005, PB064, PB065, and Atapt (interchangeably referred to herein as "PBJ"). In some aspects, the prenyl donor is selected from Dimethylallyl diphosphate (DMAPP), geranyl diphosphate (GPP), farnesyl diphosphate (FPP), geranylgeranyl pyrophosphate (GGPP), or any combination thereof. In some aspects, the prenyl donor is not a naturally occurring donor of the prenyltransferase. In some aspects, the substrate is selected from olivetolic acid (OA), divarinolic acid (DVA), olivetol (0), divarinol (DV), orsellinic acid (ORA), dihydroxybenzoic acid (DHBA), apigenin, naringenin and resveratrol. In some aspects, the substrate is not a naturally occurring substrate of the prenyltransferase.

In some aspects, the at least one prenylated product comprises a prenyl group attached to any position on an aromatic ring of the substrate. In some aspects, the at least one prenylated product is selected from the group consisting of UNK1, UNK2, UNK3, RBI-08, 5-DOA, RBI-05, RBI-06, 4-O-GOA, RBI-02 (CBGA—cannabigerolic acid), RBI-04 (5-GOA), UNK4, RBI-56, UNK5, RBI-14 (CBFA), RBI-16 (5-FOA), RBI-24, RBI-28, RBI-26 (CBGVA—cannabigerovarinic acid), RBI-27, RBI-38, RBI-39, RBI-09, RBI-10, RBI-03 (5-GO), RBI-20, RBI-01 (CBG—cannabigerol), RBI-15, RBI-34, RBI-32, RBI-33, RBI-07, RBI-29, RBI-30, RBI-12, and RBI-11.

In some aspects, the prenyltransferase is ORF2. In some aspects, the substrate is OA and the prenyl donor is DMAPP. In some aspects, the at least one prenylated product comprises a prenyl group attached to a position selected from CO; 2-O; 4-O; 3-C; 5-C; or 5-C and 3-C on the aromatic ring of OA. In some aspects, the at least one prenylated product comprises UNK1, UNK2, UNK3, RBI-08, RBI-17, or RBI-18.

In some aspects, the substrate is OA and the prenyl donor is GPP. In some aspects, the at least one prenylated product comprises a prenyl group attached to a position selected from CO; 2-O; 4-O; 3-C; 5-C; or 3-C and 5-C on the aromatic ring of OA. In some aspects, the at least one prenylated product comprises RBI-05, RBI-06, UNK-4, RBI-02 (CBGA), RBI-04 (5-GOA) or RBI-07.

In some aspects, the substrate is OA and the prenyl donor is FPP. In some aspects, the at least one prenylated product comprises a prenyl group attached to a position selected from 2-O; 4-O; 3-C; and 5-C on the aromatic ring of OA. In some aspects, the at least one prenylated product comprises RBI-56, UNK5, RBI-14 (CBFA), or RBI-16 (5-FOA).

In some aspects, the substrate is DVA and the prenyl donor is DMAPP. In some aspects, the at least one prenylated product comprises a prenyl group attached to a position selected from CO; 2-O; 4-O; 3-C; and 5-C on the aromatic ring of DVA.

In some aspects, the substrate is DVA and the prenyl donor is GPP. In some aspects, the at least one prenylated product comprises a prenyl group attached to a position selected from CO; 2-O; 4-O; 3-C; 5-C; 3-C and 5-C; or 5-C and 2-O on the aromatic ring of DVA. In some aspects, the at least one prenylated product comprises RBI-24, RBI-28, UNK11, RBI-26, RBI-27, RBI-29, or RBI-30.

In some aspects, the substrate is DVA and the prenyl donor is FPP. In some aspects, the at least one prenylated product comprises a prenyl group attached to a position selected from CO; 2-O; 4-O; 3-C; and 5-C on the aromatic ring of DVA. In some aspects, the at least one prenylated product comprises UNK12, UNK13, UNK14, RBI-38, or RBI-39.

In some aspects, the substrate is O and the prenyl donor is DMAPP. In some aspects, the at least one prenylated product comprises a prenyl group attached to a position selected from 1-C/5-C; 2-O/4-O; or 3-C on the aromatic ring of O. In some aspects, the at least one prenylated product comprises RBI-10, UNK16, or RBI-09.

In some aspects, the prenyltransferase is HypSc. In some aspects, the substrate is O and the prenyl donor is DMAPP. In some aspects, the at least one prenylated product comprises a prenyl group attached to a position selected from 1-C/5-C; 2-O/4-O; or 3-C on the aromatic ring of O. In some aspects, the at least one prenylated product comprises RBI-10, UNK16 or RBI-09.

In some aspects, the prenyltransferase is PB005. In some aspects, the substrate is 0 and the prenyl donor is DMAPP. In some aspects, the at least one prenylated product comprises a prenyl group attached to a position selected from 1-C/5-C; 2-O/4-O; 3-C; 1-C and 5-C; or 1-C and 3-C on the aromatic ring of O. In some aspects, the at least one prenylated product comprises RBI-10, UNK16, RBI-09, RBI-11 or RBI-12.

In some aspects, the substrate is O and the prenyl donor is GPP. In some aspects, the at least one prenylated product comprises a prenyl group attached to a position selected from 1-C/5-C; 2-O/4-O; or 3-C on the aromatic ring of O. In some aspects, the at least one prenylated product comprises RBI-20, RBI-01 (CBG), or RBI-03 (5-GO).

In some aspects, the substrate is O and the prenyl donor is FPP. In some aspects, the at least one prenylated product comprises a prenyl group attached to a position selected from 1-C/5-C; 2-O/4-O; 4-O/2-O; or 3-C on the aromatic ring of O. In some aspects, the at least one prenylated product comprises RBI-15, UNK18 or UNK19.

In some aspects, the substrate is DV and the prenyl donor is DMAPP. In some aspects, the at least one prenylated product comprises a prenyl group attached to a position selected from 1-C/5-C; 2-O/4-O; or 3-C on the aromatic ring of DV. In some aspects, the at least one prenylated product comprises UNK54, UNK55 or UNK56.

In some aspects, the substrate is ORA and the prenyl donor is GPP. In some aspects, the at least one prenylated product comprises a prenyl group attached to a position selected from CO, 2-O, 4-O, 3-C, 5-C, or 5-C and 3-C on the aromatic ring of ORA.

In some aspects, the substrate is ORA and the prenyl donor is DMAPP. In some aspects, the at least one prenylated product comprises a prenyl group attached to a position selected from CO, 2-O, or 5-C on the aromatic ring of ORA.

In some aspects, the substrate is ORA and the prenyl donor is DMAPP. In some aspects, the at least one prenylated product comprises a prenyl group attached to a position selected from CO, 2-O, or 4-O on the aromatic ring of ORA.

In some aspects, the substrate is ORA and the prenyl donor is DMAPP. In some aspects, the at least one prenylated product comprises a prenyl group attached to a position selected from CO, or 3-C on the aromatic ring of ORA.

In some aspects, the prenyltransferase is PB064. In some aspects, the substrate is ORA and the prenyl donor is DMAPP. In some aspects, the at least one prenylated product comprises a prenyl group attached to a position selected from CO, 2-O or 3-C on the aromatic ring of ORA.

In some aspects, the prenyltransferase is PB065. In some aspects, the substrate is ORA and the prenyl donor is DMAPP. In some aspects, the at least one prenylated product comprises a prenyl group attached to a position selected from CO, or 2-O on the aromatic ring of ORA.

In some aspects, the prenyltransferase is PB002. In some aspects, the substrate is ORA and the prenyl donor is DMAPP. In some aspects, the at least one prenylated product comprises a prenyl group attached to a position CO on the aromatic ring of ORA.

In some aspects, the prenyltransferase is Atapt. In some aspects, the substrate is ORA and the prenyl donor is DMAPP. In some aspects, the at least one prenylated product comprises a prenyl group attached to a position 4-O on the aromatic ring of ORA.

In some aspects, the substrate is ORA and the prenyl donor is FPP. In some aspects, the at least one prenylated product comprises a prenyl group attached to a position selected from CO, 2-O, 4-O, 3-C, or 5-C on the aromatic ring of ORA.

In some aspects, the substrate is DHBA and the prenyl donor is DMAPP. In some aspects, the at least one prenylated product comprises a prenyl group attached to a position selected from CO, 2-O, 4-O, 3-C, or 5-C on the aromatic ring of DHBA.

In some aspects, the substrate is DV and the prenyl donor is GPP. In some aspects, the at least one prenylated product comprises a prenyl group attached to positions 5-C and 1-C; or 3-C and 5-C on the aromatic ring of DV. In some aspects, the at least one prenylated product comprises RBI-36, or UNK35.

In some aspects, the substrate is OA and the prenyl donor is GPP, DMAPP or both. In some aspects, the at least one prenylated product comprises a prenyl group attached to positions 5-C and 3-C; or CO and 3-C on the aromatic ring of OA.

In some aspects, the substrate is OA and the prenyl donor is GPP, FPP or both. In some aspects, the at least one prenylated product comprises a prenyl group attached to positions 5-C and 3-C on the aromatic ring of OA.

In some aspects, the substrate is O and the prenyl donor is GPP, FPP or both. In some aspects, the at least one prenylated product comprises a prenyl group attached to positions 5-C and 3-C on the aromatic ring of O.

In some aspects, the substrate is apigenin and the prenyl donor is GPP. In some aspects, the at least one prenylated product comprises a prenyl group attached to a position selected from C-13; C-15; C-3; C-12; C-16; C-9; or C-5 on the aromatic ring of apigenin. In some aspects, the at least one prenylated product comprises UNK47, UNK48, UNK49, UNK50, or UNK51. In some aspects, the substrate is naringenin and the prenyl donor is GPP. In some aspects, the at least one prenylated product comprises a prenyl group attached to a position selected from C-3; or C-5 on the aromatic ring of naringenin. In some aspects, the at least one prenylated product comprises RBI-41 or RBI-42. In some aspects, the substrate is resveratrol and the prenyl donor is GPP. In some aspects, the at least one prenylated product comprises a prenyl group attached to a position selected from C-11; C-13; C-3; C-10; C-14; or C-1/5 on the aromatic ring of resveratrol. In some aspects, the at least one prenylated product comprises RBI-48 or RBI-49.

In some aspects, the substrate comprises olivetolic acid (OA), divarinolic acid (DVA), olivetol (0), resveratrol, piceattanol and related stilbenes, naringenin, apigenin and related flavanones and flavones, respectively, Isoliquiritigenin, 2'-O-methylisoliquiritigenin and related chalcones, catechins and epi-catechins of all possible stereoisomers, biphenyl compounds such as 3,5-dihydroxy-biphenyl, benzophenones such as phlorobenzophenone, isoflavones such as biochanin A, genistein, daidzein, 2,4-dihydroxybenzoic acid, 1,3-benzenediol, 2,4-dihydroxy-6-methylbenzoic acid; 1,3-Dihydroxy-5-methylbenzene; 2,4-Dihydroxy-6-aethylbenzoesaeure; 5-ethylbenzene-1,3-diol 2,4-dihydroxy-6-propylbenzoic acid; 5-propylbenzene-1,3-diol; 2-butyl-4,6-dihydroxybenzoic acid; 5-butylbenzene-1,3-diol; 2,4-dihydroxy-6-pentyl-benzoic acid; 5-pentylbenzene-1,3-diol; 5-hexylbenzene-1,3-diol; 2-heptyl-4,6-dihydroxy-benzoic acid; 5-heptylbenzene-1,3-diol; 5-Dodecylbenzene-1,3-diol; 5-nonadecylbenzene-1,3-diol; 1,3-Benzenediol; 3,4',5-Trihydroxystilbene; 4'5-Tetrahydroxystilbene; 1,2-Diphenylethylene; 2-Phenylbenzopyran-4-one; 2-Phenylchroman-4-one; 1,3-benzenediol; 5,7,4'-Trihydroxyflavone; (E)-1-(2,4-dihydroxyphenyl)-3-(4-hydroxyphenyl)prop-2-en-1-one; 4,4'-dihydroxy-2'-methoxychalcone; 1,3-Diphenylpropenone; (2R,3S)-2-(3,4-Dihydroxyphenyl)chroman-3,5,7-triol; (2R,3R)-2-(3,4-Dihydroxyphenyl)-3,5,7-chromanetriol; Phenylbenzene; 5-Phenylresorcinol; diphenylmethanone; 3-phenyl-4H-chromen-4-one; 5,7-Dihydroxy-3-(4-methoxyphenyl)-4H-chromen-4-one; 4',5,7-Trihydroxyisoflavone; 4',7-Dihydroxyisoflavone; 4-Hydroxy-6-methyl-2H-pyran-2-one; 1,6-DHN; or any combination thereof.

In some aspects, the substrate is a prenylated molecule. In some aspects, the prenylated molecule is selected from the group consisting of UNK1, UNK2, UNK3, RBI-08, 5-DOA, RBI-05, RBI-06, 4-O-GOA, RBI-02 (CBGA), RBI-04 (5-GOA), UNK4, RBI-56, UNK5, RBI-14 (CBFA), RBI-16 (5-FOA), RBI-24, RBI-28, RBI-26, RBI-27, RBI-38, RBI-39, RBI-09, RBI-10, RBI-03 (5-GO), RBI-20, RBI-01 (CBG), RBI-15, RBI-34, RBI-32, RBI-33, RBI-07, RBI-29, RBI-30, RBI-12, and RBI-11.

In some aspects, the amino acid sequence of ORF2 comprises SEQ ID NO: 1, and the at least one amino acid substitution comprises at least one amino acid substitution in SEQ ID NO: 1 on a position chosen from the group consisting of amino acid positions 17, 25, 38, 49, 53, 106, 108, 112, 118, 119, 121, 123, 161, 162, 166, 173, 174, 177, 205, 209, 213, 214, 216, 219, 227, 228, 230, 232, 271, 274, 283, 286, 288, 294, 295, and 298. In some aspects, the at least one amino acid substitution is located on a position chosen from the group consisting of amino acid positions 17, 25, 38, 49, 53, 106, 108, 112, 118, 119, 162, 166, 173, 174, 205, 209, 213, 219, 227, 228, 230, 232, 271, 274, 283, 286, 288, and 298. In some aspects, the amino acid sequence of ORF2 comprises SEQ ID NO: 1, and the at least one amino acid substitution is chosen from the group consisting of A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W.

In some aspects, the amino acid sequence of ORF2 comprises SEQ ID NO: 1, and the at least one amino acid substitution to SEQ ID NO: 1 comprises two or more amino acid substitutions to SEQ ID NO: 1 selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W;

OR (b) A53T and 5214R; S177W and Q295A; S214R and Q295F; Q161S and 5214R; S177W and 5214R; Q161S and Q295L; Q161S and Q295F; V49A and 5214R; A53T and Q295F; Q161S and S177W; Q161S, V294A and Q295W; A53T, Q161S and Q295W; A53T and S177W; A53T, Q161S, V294A and Q295W; A53T, V294A and Q295A; V49A and Q295L; A53T, Q161S, V294N and Q295W; A53T and Q295A; Q161S, V294A and Q295A; A53T and Q295W; A53T, V294A and Q295W; A53T, Q161S and Q295A; A53T, Q161S, V294A and Q295A; and A53T, Q161S, V294N and Q295A.

In some aspects, the at least one prenylated product comprises UNK6, UNK7, UNK8, UNK9, or UNK10. In some aspects, the at least one prenylated product comprises UNK20, UNK21, UNK22, UNK23, UNK24, or UNK59. In some aspects, the at least one prenylated product comprises UNK25, UNK26, or UNK29. In some aspects, the at least least one prenylated product comprises UNK25, UNK26 or UNK27. In some aspects, the at least one prenylated product comprises UNK25 or UNK28. In some aspects, the at least one prenylated product comprises UNK25, UNK26 or UNK28. In some aspects, the at least one prenylated product comprises UNK25 or UNK26. In some aspects, the at least one prenylated product comprises UNK25. In some aspects, the at least one prenylated product comprises UNK27. In some aspects, the at least one prenylated product comprises UNK30, UNK31, UNK32, UNK33, or UNK34. In some aspects, the at least one prenylated product comprises UNK36, UNK38, or RBI-22. In some aspects, the at least one prenylated product comprises UNK42. In some aspects, the at least one prenylated product comprises UNK46.

In some aspects, the substrate is DV and the prenyl donor is GPP. In some aspects, the at least one prenylated product comprises a prenyl group attached to a position selected from 3-C, 1-C, or 5-C on the aromatic ring of DV. In some aspects, the at least one prenylated product comprises RBI-32 or RBI-33.

In some aspects, the substrate is OA and the prenyl donor is GGPP. In some aspects, the at least one prenylated product comprises a prenyl group attached to a position selected from 3-C, or 5-C on the aromatic ring of OA. In some aspects, the at least one prenylated product comprises UNK60 or UNK61.

In some aspects, the substrate is ORA and the prenyl donor is GGPP. In some aspects, the at least one prenylated product comprises a prenyl group attached to a position selected from 3-C, or 5-C on the aromatic ring of ORA. In some aspects, the at least one prenylated product comprises UNK62 or UNK63.

In some aspects, the substrate is DVA and the prenyl donor is GGPP. In some aspects, the at least one prenylated product comprises a prenyl group attached to a position selected from 3-C, or 5-C on the aromatic ring of DVA. In some aspects, the at least one prenylated product comprises UNK64 or UNK65.

The disclosure further provides nucleic acid molecules, comprising a nucleotide sequence encoding any one of the recombinant polypeptides disclosed herein, or a codon degenerate nucleotide sequence thereof. In some aspects, the nucleotide sequence comprises at least 500, 600, 700, 800, or 900 nucleotides. In some aspects, the nucleic acid molecule is isolated and purified.

The disclosure provides a cell vector, construct or expression system comprising any one of the nucleic acid molecules disclosed herein; and a cell, comprising any one of the cell vectors, constructs or expression systems disclosed herein. In some aspects, the cell is a bacteria, yeast, insect, mammalian, fungi, vascular plant, or non-vascular plant cell. In some aspects, the cell is a microalgae cell. In some aspects, the cell is an *E. coli* cell.

The disclosure provides a plant, comprising any one of the cells disclosed herein. In some aspects, the plant is a terrestrial plant.

The disclosure provides methods of producing at least one prenylated product, comprising, contacting any one of the recombinant polypeptides disclosed herein with a substrate and a prenyl donor, thereby producing at least one prenylated product.

The disclosure provides methods of producing at least one prenylated product, comprising, a) contacting a first recombinant polypeptide with a substrate and a first prenyl donor, wherein the first recombinant polypeptide is any of the recombinant polypeptides disclosed herein, thereby producing a first prenylated product; and b) contacting the first prenylated product and a second prenyl donor with a second recombinant polypeptide, thereby producing a second prenylated product.

In some aspects, the first recombinant polypeptide is the same as the second recombinant polypeptide. In some aspects, the first recombinant polypeptide is different from the second recombinant polypeptide. In some aspects, the first prenyl donor is the same as the second prenyl donor. In some aspects, the first prenyl donor is different from the second prenyl donor. In some aspects, the first prenylated product is the same as the second prenylated product. In some aspects, the first prenylated product is different from the second prenylated product.

In some aspects, (a) the first recombinant polypeptide is a recombinant polypeptide wherein the prenyltransferase is ORF2, and the second recombinant polypeptide is a recombinant polypeptide wherein the prenyltransferase is PB005; or the first recombinant polypeptide is a recombinant polypeptide wherein the prenyltransferase is PB005 and the second recombinant polypeptide is a recombinant polypeptide wherein the prenyltransferase is ORF2; (b) the first prenyl donor is GPP and the second prenyl donor is DMAPP; or the first prenyl donor is DMAPP, and the second prenyl donor is GPP; and (c) the substrate is O. In some aspects, the first prenylated product or the second prenylated product comprises a prenyl group attached to positions of 5-C and 3-C; 5-C and 1-C; and 5-C, 1-C and 3-C on the aromatic ring of 0.

In some aspects, (a) the first recombinant polypeptide is a recombinant polypeptide wherein the prenyltransferase is ORF2, and the second recombinant polypeptide is a recombinant polypeptide wherein the prenyltransferase is PB005; or the first recombinant polypeptide is a recombinant polypeptide wherein the prenyltransferase is PB005 and the second recombinant polypeptide is a recombinant polypeptide wherein the prenyltransferase is ORF2; (b) the first prenyl donor is FPP and the second prenyl donor is DMAPP; or the first prenyl donor is DMAPP, and the second prenyl donor is FPP; and (c) the substrate is O. In some aspects, the first prenylated product or the second prenylated product comprises a prenyl group attached to positions 5-C and 3-C; or 5-C and 1-C on the aromatic ring of O.

In some aspects, the second recombinant polypeptide is a cyclase. In some aspects, the cyclase comprises cannabidiolic acid synthase (CBDAS) or tetrahydrocannabinolic acid synthase (THCAS). Further details on CBDAS and THCAS are provided in "Cannabidiolic—acid synthase, the chemotype—determining enzyme in the fiber—type *Cannabis sativa*" Taura et al., Volume 581, Issue 16, Jun. 26, 2007, Pages 2929-2934; and "The Gene Controlling Marijuana Psychoactivity. Molecular Cloning and Heterologous Expression of Δl-Tetrahydrocannabinolic acid synthase from *Cannabis sativa* L." Sirikantaramas et al. The Journal of Biological Chemistry, Vol. 279, No. 38, Issue of September 17, pp. 39767-39774, 2004, respectively, each of which is incorporated herein by reference in their entireties for all purposes.

In some aspects, the cyclase is derived from a plant belonging to the *Rhododendron* genus and wherein the cyclase cyclizes an FPP moiety. In some aspects, the cyclase is Daurichromenic Acid Synthase (DCAS). Further details on DCAS is provided in "Identification and Characterization of Daurichromenic Acid Synthase Active in Anti-HIV Biosynthesis" Iijima et al. Plant Physiology August 2017, 174 (4) 2213-2230, the contents of which are incorporated herein by reference in its entirety.

In some aspects, the secondary enzyme is a methyltransferase. In some cases, the methyltransferase is a histone methyltransferase, N-terminal methyltransferase, DNA/RNA methyltransferase, natural product methyltransferase, or non-SAM dependent methyltransferases.

In some aspects, the at least one prenylated product comprises UNK40, UNK41, UNK66 or UNK67. In some aspects, the at least one prenylated product comprises UNK44 or UNK45.

In some aspects, the first recombinant polypeptide is PB005, and the second recombinant polypeptide is HypSc; or the first recombinant polypeptide is HypSc, and the second recombinant polypeptide is PB005. In some aspects, the substrate is DV; and the first prenyl donor and the second prenyl donor is DMAPP. In some aspects, the at least one prenylated product comprises a prenyl group attached to positions of 5C and 3C; or 5C and 1C on the aromatic ring of DV. In some aspects, the at least one prenylated product comprises UNK57 or UNK58.

The disclosure further provides compositions comprising the at least one prenylated product produced by any one of the methods disclosed herein. The disclosure also provides compositions comprising the first prenylated product and/or the second prenylated product produced by any one of the methods disclosed herein.

The disclosure provides a composition comprising a prenylated product, wherein the prenylated product comprises a substitution by a prenyl donor on an aromatic ring of a substrate, wherein the substrate is selected from the group consisting of olivetolic acid (OA), divarinolic acid (DVA), olivetol (0), divarinol (DV), orsellinic acid (ORA), dihydroxybenzoic acid (DHBA), apigenin, naringenin and resveratrol.

In some aspects, the prenyl donor is selected from the group consisting of DMAPP, GPP, FPP, GGPP, and any combination thereof. In some aspects, the prenylated product is selected from any of the prenylated products in Table C. In some aspects, the prenylated product is selected from the group consisting of UNK1, UNK2, UNK3, RBI-08, RBI-17, RBI-05, RBI-06, UNK4, RBI-02 (CBGA), RBI-04 (5-GOA), RBI-56, UNK5, RBI-14 (CBFA), RBI-16 (5-FOA), UNK6, UNK7, UNK8, UNK9, UNK10, RBI-24, RBI-28, UNK11, RBI-26 (CBGVA), RBI-27, UNK12, UNK13, UNK14, RBI-38, RBI-39, RBI-10, UNK16, RBI-09, RBI-10, UNK16, RBI-09, RBI-10, UNK16, RBI-09, RBI-10, RBI-03 (5-GO), RBI-20, RBI-01 (CBG), RBI-03 (5-GO), RBI-15, UNK18, UNK19, RBI-15, UNK54, UNK55, UNK56, UNK54, UNK20, UNK21, UNK22, UNK23, UNK24, UNK25, UNK26, UNK27, UNK28, UNK29, RBI-32, RBI-33, UNK30, UNK31, UNK32, UNK33, UNK34, UNK60, UNK61, UNK62, UNK63, UNK64, UNK65, RBI-07, RBI-29, RBI-30, RBI-36, UNK35, UNK36, RBI-22, UNK38, RBI-18, UNK40, UNK41, UNK42, RBI-12, RBI-11, UNK44, UNK45, UNK46, UNK57, UNK58, UNK59, UNK66, and UNK67. In some aspects, the prenylated product is selected from the group consisting of RBI-01, RBI-02, RBI-03, RBI-04, RBI-05, RBI-07, RBI-08, RBI-09, RBI-10, RBI-11, and RBI-12. In some aspects, the prenylated product is RBI-29 or UNK59.

BRIEF DESCRIPTION OF THE FIGURES

FIG. 16 shows the predicted prenylation products using OA as substrate and DMAPP as Donor.

FIG. 17 shows the predicted prenylation products using OA as substrate and GPP as Donor.

FIG. 18 shows the predicted prenylation products using OA as substrate and FPP as Donor.

FIG. 19 shows the predicted prenylation products using O as substrate and GPP as Donor.

FIG. 20 shows the predicted prenylation products using DVA as substrate and GPP as Donor.

FIG. 21 shows the predicted prenylation products using DVA as substrate and FPP as Donor.

FIG. 22 shows the predicted prenylation products using ORA as substrate and GPP as Donor.

FIG. 23 shows the predicted prenylation products using Apigenin as substrate and GPP as Donor.

FIG. 24 shows the predicted prenylation products using Naringenin as substrate and GPP as Donor.

FIG. 25 shows the predicted prenylation products using Reservatrol as substrate and GPP as Donor.

FIG. 26 shows the predicted prenylation products using ORA as substrate and DMAPP as Donor.

FIG. 27 shows the predicted prenylation products using DV as substrate and DMAPP as Donor.

FIG. 28 shows the predicted prenylation products using DV as substrate and GPP as Donor.

FIG. 29 shows the predicted prenylation products using DVA as substrate and DMAPP as Donor.

FIG. 30 shows the predicted prenylation products using O as substrate and DMAPP as Donor.

FIG. 31 shows the predicted prenylation products using CBGA as substrate and DMAPP as Donor.

FIG. 32 shows the predicted prenylation products using RBI-04 as substrate and DMAPP as Donor.

FIG. 33 shows the predicted prenylation products using RBI-04 as substrate and FPP as Donor.

FIG. 34 shows the predicted prenylation products using RBI-04 as substrate and GPP as Donor.

FIG. 35 shows the predicted prenylation products using RBI-08 as substrate and DMAPP as Donor.

FIG. 36 shows the predicted prenylation products using RBI-08 as substrate and GPP as Donor.

FIG. 37 shows the predicted prenylation products using RBI-09 as substrate and GPP as Donor.

FIG. 38 shows the predicted prenylation products using RBI-10 as substrate and DMAPP as Donor.

FIG. 39 shows the predicted prenylation products using RBI-10 as substrate and FPP as Donor.

FIG. 40 shows the predicted prenylation products using RBI-10 as substrate and GPP as Donor.

FIG. 41 shows the predicted prenylation products using RBI-12 as substrate and GPP as Donor.

FIG. 42 shows the predicted prenylation products using RBI-03 as substrate and DMAPP as Donor.

FIG. 43 shows the predicted prenylation products using O as substrate and FPP as Donor.

FIG. 44 shows the predicted prenylation products using ORA as substrate and FPP as Donor.

FIG. 45 shows the predicted prenylation products using OA as substrate and GGPP as Donor.

FIG. 46 shows the predicted prenylation products using ORA as substrate and GGPP as Donor.

FIG. 47 shows the predicted prenylation products using DVA as substrate and GGPP as Donor.

FIG. 48 shows the prenylation site numbering for alkylresorcinol substrates (i.e. DV, O, etc).

FIG. 49 shows the prenylation site numbering for alkylresorcyclic acid substrates (i.e. ORA, DVA, OA, etc.)

FIG. 50 shows the Apigenin prenylation site numbering.

FIG. 51 shows the Naringenin prenylation site numbering.

FIG. 52 shows the Reservatrol prenylation site numbering.

FIG. 57: Cluster map of ORF2 triple mutants clustered based on CBFA production potential and %5-FOA produced, using OA as substrate and FPP as donor

FIG. 59: Analysis of ORF-2 enzymatic function of mutants derived from the breakdown of ORF-2 triple mutant clone CO5

DETAILED DESCRIPTION

Definitions

Figure 1:
FIG. 1 shows a heatmap of prenylated products produced from Orf2 mutants when using OA as substrate and DMAPP as donor.

As used herein, and in the appended claims, the singular forms "a", "an", and "the" include plural referents unless the context clearly dictates otherwise. Thus, for example, reference to "a protein" can refer to one protein or to mixtures of such protein, and reference to "the method" includes reference to equivalent steps and/or processes known to those skilled in the art, and so forth.

As used herein, the term "about" or "approximately" when preceding a numerical value indicates the value plus or minus a range of 10%. For example, "about 100" encompasses 90 and 110.

The term "wild type", abbreviated as "WT", is a term of the art understood by skilled persons and means the typical form of an organism, strain, gene, protein, or characteristic as it occurs in nature as distinguished from mutant or variant forms. For example, a WT protein is the typical form of that protein as it occurs in nature.

The term "mutant protein" is a term of the art understood by skilled persons and refers to a protein that is distinguished from the WT form of the protein on the basis of the presence of amino acid modifications, such as, for example, amino acid substitutions, insertions and/or deletions.

Amino acid modifications may be amino acid substitutions, amino acid deletions and/or amino acid insertions. Amino acid substitutions may be conservative amino acid substitutions or non-conservative amino acid substitutions. A conservative replacement (also called a conservative mutation, a conservative substitution or a conservative variation) is an amino acid replacement in a protein that changes a given amino acid to a different amino acid with similar biochemical properties (e.g. charge, hydrophobicity and size). As used herein, "conservative variations" refer to the replacement of an amino acid residue by another, biologically similar residue. Examples of conservative variations include the substitution of one hydrophobic residue such as isoleucine, valine, leucine or methionine for another; or the substitution of one polar residue for another, such as the substitution of arginine for lysine, glutamic for aspartic acids, or glutamine for asparagine, and the like. Other illustrative examples of conservative substitutions include the changes of: alanine to serine; arginine to lysine; asparagine to glutamine or histidine; aspartate to glutamate; cysteine to serine; glutamine to asparagine; glutamate to aspartate; glycine to praline; histidine to asparagine or glutamine; isoleucine to leucine or valine; leucine to valine or isoleucine; lysine to arginine, glutamine, or glutamate; methionine to leucine or isoleucine; phenylalanine to tyrosine, leucine or methionine; serine to threonine; threonine to serine; tryptophan to tyrosine; tyrosine to tryptophan or phenylalanine; valine to isoleucine or leucine, and the like.

Amino acid substitution, interchangeably referred to as amino acid replacement, at a specific position on the protein sequence is denoted herein in the following manner: "one letter code of the WT amino acid residue—amino acid position—one letter code of the amino acid residue that replaces this WT residue". For example, an ORF2 polypeptide which is a Q295F mutant refers to an ORF2 polypeptide in which the wild type residue at the $295^{th}$ amino acid position (Q or glutamine) is replaced with F or phenylalanine. Some mutants have more than one amino acid substitutions, for example, mutant L174V_S177E refers to an ORF2 polypeptide in which the wild type residue at the 174th amino acid position (L or leucine) is replaced with V or valine; and the wild type residue at the 177th amino acid position (S or serine) is replaced with E or glutamic acid.

The modified peptides can be chemically synthesized, or the isolated gene can be site-directed mutagenized, or a synthetic gene can be synthesized and expressed in bacteria, yeast, baculovirus, tissue culture, and the like.

As used herein, "total prenylated products" produced refers to the sum of nMols of the various prenylated products produced by an enzyme in a set period of time. For instance, when OA is used as a substrate and GPP is used as a donor, then the "total prenylated products" refers to a sum of the nMol of CBGA and the nMol of 5-GOA produced by the prenyltranferase enzyme ORF2 in a set period of time.

As used herein, "% prenylated product 1" within total prenylated products is calculated using the equation: nMol of prenylated product 1/[nMol of total prenylated products]. For example, "% CBGA" is calculated using the equation: nMol of CBGA/[nMol of CBGA+5-GOA]. Also, as an example, "%5-GOA" within prenylated products is calculated using the equation: nMol of 5-GOA/[nMol of CBGA+5-GOA].

As used herein, % enzymatic activity of an ORF2 mutant is calculated using the equation: total prenylated products produced by a mutant/total prenylated products produced by wild-type ORF2. For example, wild-type ORF2 has 100% enzyme activity.

As used herein, the production or production potential of a prenylated product 1 is calculated using the formula: % product 1 among total prenylated products*% enzymatic activity. For example, "CBGA production potential" (used interchangeably with "CBGA production") is calculated using the equation: % CBGA among total prenylated products*% enzymatic activity. Also, as an example, "5-GOA production potential" (used interchangeably with "5-GOA production") is calculated using the equation: %5-GOA among total prenylated products*% enzymatic activity.

A "vector" is used to transfer genetic material into a target cell. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, adenoviruses, lentiviruses, and adeno-associated viruses). In embodiments, a viral vector may be replication incompetent. Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

As used herein "sequence identity" refers to the extent to which two optimally aligned polynucleotides or polypeptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as, for example, those in the BLAST suite of sequence analysis programs.

As used herein, the code names refer to the chemical compounds described in the specification and drawing of the present application. For example, the code name "RBI-24" refers to the chemical compound (E)-3,7-dimethylocta-2,6-dien-1-yl 2,4-dihydroxy-6-propylbenzoate, the chemical structure of which is shown in FIG. 20. Similarly, the code name "UNK20" refers to the chemical compound (E)-3,7-dimethylocta-2,6-dien-1-yl2,4-dihydroxy-6-methylbenzoate, the chemical structure of which is shown in FIG. 22.

Cannabinoid Synthesis

The biosynthesis of cannabinoids often starts with the short-chain fatty acid, hexanoic acid. Initially, the fatty acid is converted to its coenzyme A (CoA) form by the activity of an acyl activating enzyme. Subsequently, olivetolic acid (OA) is biosynthesized by the action of a type III polyketide synthase (PKS), and, in some cases, a polyketide cyclase (olivetolic acid cyclase [OAC]).

A geranyl diphosphate:olivetolate geranyltransferase, named cannabigerolic acid synthase (CBGAS), is responsible for the C-alkylation by geranyl diphosphate (GPP) to CBGA. Subsequently, the monoterpene moiety of CBGA is often stereoselectively cyclized by three different enzymes cannabichromenic acid synthase (CBCAS), cannabidiolic acid synthase (CBDAS) and tetrahydrocannabinolic acid synthase (THCAS) to synthesize cannabichromenic acid (CBCA), cannabidiolic acid (CBDA) and $\Delta^9$-THCA, respectively.

The central precursor for cannabinoid biosynthesis, CBGA, is synthesized by the aromatic prenyltransferase CBGAS by the condensation of GPP and OA. In considering the biosynthesis of cannabinoids in a heterologous system, one major challenge is that CBGAS (e.g. CsPT1 and CsPT4) is an integral membrane protein, making high titer of functional expressed protein in *E. coli* and other heterologous systems unlikely. Besides the integral membrane prenyltransferases found in plants, soluble prenyltransferases are found in fungi and bacteria. For instance, *Streptomyces* sp. strain CL190 produces a soluble prenyltransferase NphB or ORF2, which is specific for GPP as a prenyl donor and exhibits broad substrate specificity towards aromatic substrates. When expressed in *E. coli*, ORF2 of SEQ ID NO:2 is as a 33 kDa soluble, monomeric protein having 307 residues. Further details about ORF2 and other aromatic prenyltransferases may be found in U.S. Pat. Nos. 7,361,483; 7,544,498; and 8,124,390, each of which is incorporated herein by reference in its entirety for all purposes.

ORF2 is a potential alternative to replace the native CBGAS in a biotechnological production of cannabinoids and other prenylated aromatic compounds. However, the wild type ORF2 enzyme produces a large amount of 5-geranyl olivetolate (5-GOA) and only a minor amount of CBGA, the latter of which is the desired product for cannabinoid biosynthesis.

Further, other prenyltransferase homologues of ORF2 include HypSc, PB002, PB005, PB064, PB065, and Atapt.

This disclosure provides prenyltransferase mutants, engineered by the inventors to produce produces a ratio of an amount of at least one prenylated product to an amount of total prenylated products that is higher than that produced by the WT prenyltransferase under the same conditions. The disclosure also provides prenyltransferase mutants which have been engineered to catalyze reactions using a desired substrate and/or a desired donor and to produce higher amounts of a desired product, as compared to the WT prenyltransferase under the same conditions.

The production of cannabinoids at large industrial scale is made possible using microalgae and dark fermentation. Engineering into the chloroplast of the microalgae offers unique compartmentalization and environment. The *Cannabis* plant genes express in this single cell plant system and have the post-translational modifications. This dark fermentation process allows one to drive cell densities beyond 100 g/per liter and has been scaled to 10,000 L.

Prenyltransferase Mutants

The disclosure provides recombinant polypeptides comprising an amino acid sequence with at least about 70% identity to the amino acid sequence of WT prenyltransferase. In some aspects, the polypeptides disclosed herein may have a sequence identity of about 70%, about 75%, about 80%, about 85%, about 90%, about 95%, about 96%, about 97%, about 98%, about 99%, or about 99.5% identity to the amino acid sequence of WT prenyltransferase. In some aspects, the mutant recombinant polypeptides (interchangeably used with "recombinant polypeptides") disclosed herein may comprise a modification at one or more amino acids, as compared to the WT prenyltransferase sequence. In some aspects, the mutant recombinant polypeptides disclosed herein may comprise a modification at 1 amino acid, 2 amino acids, 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, or 36 amino acids, as compared to the WT prenyltransferase sequence.

In some aspects, the prenyltransferase is selected from the group consisting of ORF2, HypSc, PB002, PB005, PB064, PB065, and Atapt. The amino acid sequence of ORF2 is set forth in SEQ ID NO: 1. The amino acid sequence of PB005 is set forth in SEQ ID NO: 602. The amino acid sequence of PBJ or Atapt is set forth in SEQ ID NO: 604.

In some aspects, the prenyltransferase belongs to the ABBA family of prenyltransferases. In some aspects, the prenyltransferase comprises a protein fold with a central barrel comprising ten anti-parallel β-strands surrounded by α-helices giving rise to a repeated α-β-β-α (or "ABBA") motif. Further details of this family and examples of prenyltransferases that may be used are provided in "The ABBA family of aromatic prenyltransferases: broadening natural product diversity" Tello et al. Cell. Mol. Life Sci. 65 (2008) 1459-1463, the contents of which are incorporated herein by reference in its entirety for all purposes.

In some aspects, the prenyltransferase is ORF2 comprising an amino acid sequence set forth in SEQ ID NO: 1. In some aspects, mutant recombinant polypeptides disclosed herein comprise a modification in one or more amino acid residues selected from the group consisting of the following amino acid residues, A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298 of the WT ORF2 polypeptide. For instance, the mutant ORF2 polypeptides disclosed herein may comprise an amino acid modification at 1 amino acid, 2 amino acids, 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, or 36 amino acids selected from the group consisting of the following amino acid residues, A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298 of the WT ORF2 polypeptide.

In some aspects, the mutant ORF2 polypeptides disclosed herein may comprise an amino acid substitution of at least one amino acid residue selected from the group consisting of A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298. For instance, the mutant ORF2 polypeptides disclosed herein may comprise an amino acid substitution of 1 amino acid, 2 amino acids, 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, or 36 amino acids selected from the group consisting of A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298.

In some aspects, the mutant ORF2 polypeptides disclosed herein comprise an amino acid sequence comprising at least one amino acid substitution, as compared to the amino acid sequence of WT ORF2, wherein the at least one amino acid substitution does not comprise an alanine substitution on an amino acid residue selected from the group consisting of 47, 64, 110, 121, 123, 126, 161, 175, 177, 214, 216, 288, 294 and 295.

In some aspects, the mutant ORF2 polypeptides disclosed herein comprise an amino acid sequence comprising at least one amino acid substitution, as compared to the amino acid sequence of WT ORF2, wherein at least one amino acid substitution is at a position selected from the group consisting of 1-46, 48-63, 65-109, 111-120, 122, 124, 125, 127-160, 162-174, 176, 178-213, 215, 217-287, 289-293, 296-307, on WT-ORF2.

In some aspects, the mutant ORF2 polypeptides disclosed herein comprise an amino acid sequence with at least about 70% identity (for instance, about 75%, about 80%, about 85%, about 90%, about 95%, about 96%, about 97%, about 98%, about 99%, or about 99.5% identity, inclusive of all values and subranges therebetween) to the amino acid sequence of SEQ ID Nos 2-300. In some aspects, the mutant ORF2 polypeptides disclosed herein comprise the amino acid sequence of SEQ ID Nos 2-300. In some aspects, the mutant ORF2 polypeptides disclosed herein consist of the amino acid sequence of SEQ ID Nos 2-300.

In some aspects, the mutant recombinant polypeptides disclosed herein catalyze a reaction using at least one prenyl donor. In some aspects, the at least one prenyl donor is DMAPP, GPP, FPP, or any combination thereof.

In some aspects, the mutant recombinant polypeptide uses a donor that is not a naturally occurring donor of the WT prenyltransferase. A "naturally-occurring donor" as used herein, refers to the donor that is used by the WT prenyltransferase to catalyze a prenylation reaction in nature (such as, in the organism that the WT prenyltransferase is found in nature). For instance, a naturally occurring donor of WT ORF2 is GPP; the disclosure provides ORF2 mutants that are able to use donors other than GPP (such as FPP) in the prenylation reaction.

In some aspects, the mutant recombinant polypeptides disclosed herein catalyze a reaction using any known substrate of a prenyltransferase such as ORF2, HypSc, PB002, PB005, PB064, PB065, and Atapt. In some aspects, the substrate is selected from the group consisting of OA, DVA, O, DV, ORA, DHBA, apigenin, naringenin and resveratrol.

In some aspects, the mutant recombinant polypeptide uses a substrate that is not a naturally occurring substrate of the WT prenyltransferase. A "naturally-occurring substrate" as used herein, refers to a substrate that is used by the WT prenyltransferase to catalyze a prenylation reaction in nature (such as, in the organism that the WT prenyltransferase is found in nature). For instance, a naturally occurring substrate of WT ORF2 is 1,3,6,8-tetrahydroxynaphthalene (THN); the disclosure provides ORF2 mutants that are able to use substrates other than THN (such as OA, apigenin, etc) in the prenylation reaction. Further details are provided in "Structural basis for the promiscuous biosynthetic prenylation of aromatic natural products" Kuzuyama et al., Nature volume 435, pages 983-987 (2005), the contents of which are incorporated by reference in its entirety.

In some aspects, the substrate is any natural or synthetic phenolic acids with a 1, 3-dihydroxyl motif, alternatively a resorcinol ring including but not limited to resveratrol, piceattanol and related stilbenes, naringenin, apigenin and related flavanones and flavones, respectively, Isoliquiritigenin, 2'-O-methylisoliquiritigenin and related chalcones, catechins and epi-catechins of all possible stereoisomers, biphenyl compounds such as 3,5-dihydroxy-biphenyl, benzophenones such as phlorobenzophenone, isoflavones such as biochanin A, genistein, and daidzein. For instance, the substrate may be any substrate listed in Tables A and B; and FIGS. 117-119.

TABLE A

| Examples of ORF2 substrates which are benzoic acids and benzenediols | | | |
|---|---|---|---|
| IUPAC Chemical Name | Common Name | Tail Chain Length | CAS # |
| 2,4-dihydroxybenzoic acid | β-Resorcylic acid | 0-carbon | 89-86-1 |
| 1,3-benzenediol | resorcinol | 0-carbon | 108-46-3 |
| 2,4-dihydroxy-6-methylbenzoic acid | o-orsellinic Acid | 1-carbon | 480-64-8 |
| 1,3-Dihydroxy-5-methylbenzene | Orcinol | 1-carbon | 504-15-4 |
| 2,4-Dihydroxy-6-aethyl-benzoesaeure | | 2-carbon | 4299-73-4 |
| 5-ethylbenzene-1,3-diol | | 2-carbon | 4299-72-3 |
| 2,4-dihydroxy-6-propylbenzoic acid | Divarinic Acid | 3-carbon | 4707-50-0 |
| 5-propylbenzene-1,3-diol | Divarin | 3-carbon | 500-49-2 |
| 2-butyl-4,6-dihydroxybenzoic acid | | 4-carbon | 173324-41-9 |
| 5-butylbenzene-1,3-diol | | 4-carbon | 46113-76-2 |
| 2,4-dihydroxy-6-pentyl-benzoic acid; | Olivetolic Acid | 5-carbon | 491-72-5 |
| 5-pentylbenzene-1,3-diol | Olivetol | 5-carbon | 500-66-3 |
| 5-hexylbenzene-1,3-diol | | 6-carbon | 5465-20-3 |
| 2-heptyl-4,6-dihydroxy-benzoic acid | sphaerophorolcarboxylic acid | 7-carbon | 6121-76-2 |
| 5-heptylbenzene-1,3-diol | Sphaerophorol | 7-carbon | 500-67-4 |
| 5-Dodecylbenzene-1,3-diol | | 12-carbon | 72707-60-9 |
| 5-nonadecylbenzene-1,3-diol | | 19-carbon | 35176-46-6 |

TABLE B

| Examples of other aromatic compounds which are ORF2 substrates | | |
|---|---|---|
| IUPAC Chemical Name | Common Name | CAS # |
| 1,3-Benzenediol | resorcinol | 108-46-3 |
| 3,4',5-Trihydroxystilbene | resveratrol | 89-86-1 |
| 4'5-Tetrahydroxystilbene | Piceatannol | 4339-71-3 |
| 1,2-Diphenylethylene | stilbene | 103-30-0 |
| 2-Phenylbenzopyran-4-one | flavone | 525-82-6 |
| 2-Phenylchroman-4-one | flavanone | 487-26-3 |
| 1,3-benzenediol | naringenin | 108-46-3 |
| 5,7,4'-Trihydroxyflavone | apigenin | 8002-66-2 |
| (E)-1-(2,4-dihydroxyphenyl)-3-(4-hydroxyphenyl)prop-2-en-1-one | Isoliquiritigenin | 961-29-5 |
| 4,4'-dihydroxy-2'-methoxychalcone | 2'-O-Methylisoliquiritigenin | 112408-67-0 |
| 1,3-Diphenylpropenone | chalcone | 94-41-7 |
| (2R,3S)-2-(3,4-Dihyroxyphenyl)chroman-3,5,7-triol | catechin | 7295-85-4 |
| (2R,3R)-2-(3,4-Dihydroxyphenyl)-3,5,7-chromanetriol | epi-catechin | 7295-85-4 |
| Phenylbenzene | biphenyl | 92-52-4 |
| 5-Phenylresorcinol | 3,5-Dihydroxy biphenyl | 7028-41-3 |
| diphenylmethanone | benzophenone | 119-61-9 |
| 3-phenyl-4H-chromen-4-one | isoflavone | 574-12-9 |
| 5,7-Dihydroxy-3-(4-methoxyphenyl)-4H-chromen-4-one | biochanin A | 491-80-5 |
| 4',5,7-Trihydroxyisoflavone | Genistein | 690224-00-1 |
| 4',7-Dihydroxyisoflavone | Diadzein | 486-66-8 |
| 4-Hydroxy-6-methyl-2H-pyran-2-one | Triacetic acid lactone | 675-10-5 |
| 1,6-DHN | | 575-44-0 |

In some aspects, the products of ORF2 prenylation may further serve as substrates for ORF2. Therefore, the substrate may also be any product of an ORF2 prenylation reaction.

In some aspects, the mutant recombinant polypeptides disclosed herein produce a higher amount of total nMol of prenylated products than the WT prenyltransferase. In some aspects, the mutant recombinant polypeptides disclosed herein produce an amount of total nMol of prenylated products that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the amount of total nMol of prenylated products produced by WT prenyltransferase.

In some aspects, the mutant recombinant polypeptides disclosed herein have an enzymatic activity higher than WT prenyltransferase. In some aspects, the mutant recombinant polypeptides disclosed herein have an activity that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the enzymatic activity of WT prenyltransferase.

Mechanism of ORF2 Function

Figure 78:
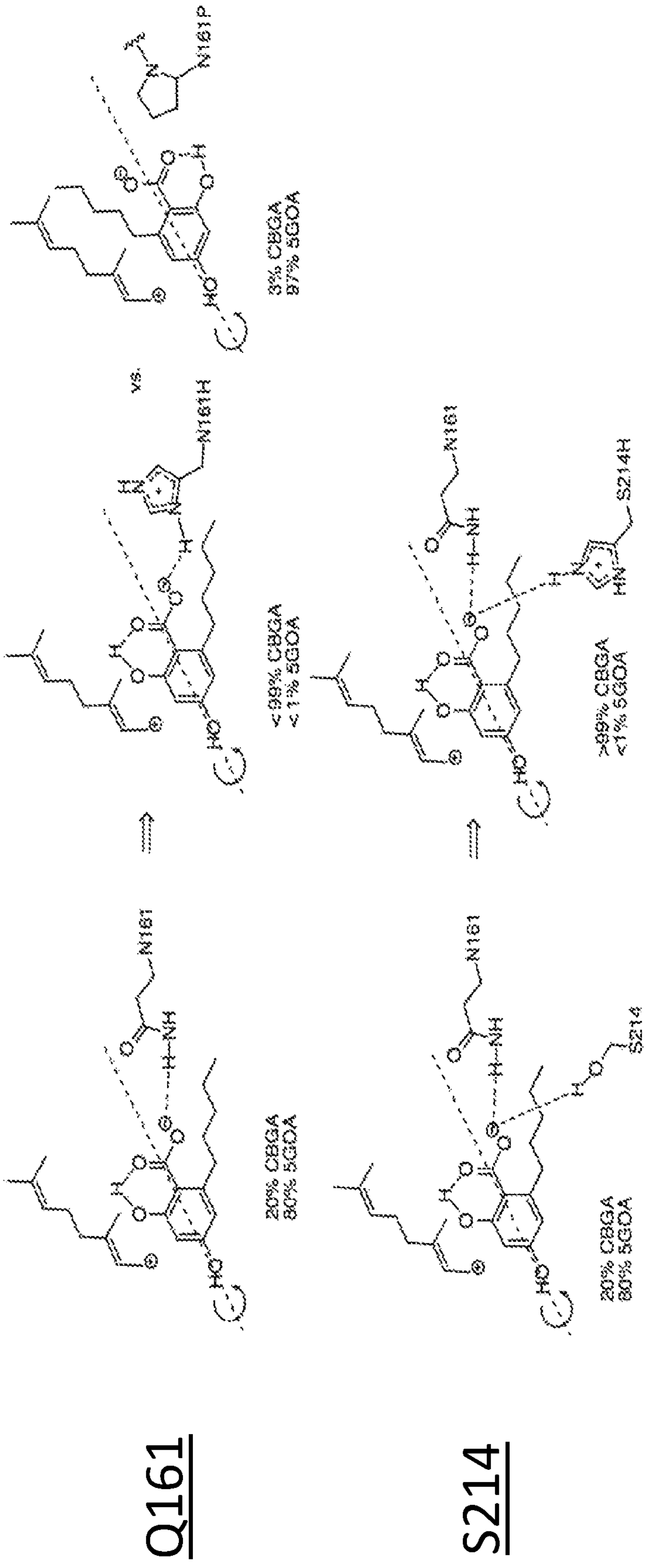
FIG. 78: Complete amino acid replacement at position Q161 and S214 in Orf2 allows a structure function mechanism for CBGA production and regiospecific prenylation.

The inventors have discovered a ratcheting mechanism of Orf2 mutants at Q161 and S214. WT enzyme contains an active site Q161 and 5214 which both form a weak hydrogen bond with the carboxylate of olivetolic acid, resulting in a 1:5 ratio CBGA:5GOA. Mutagenesis at position Q161 to Q161H, creating a more permanent hydrogen bond donor results in almost 100% CBGA production. Mutation to Q161P loses the hydrogen bond donor, as well as modifying the secondary structure at this position. Here the olivetolic acid flips its binding position within the active site, resulting in 97% 5GOA. Similarly 5214, which sits opposite in the pocket, can be mutated to S214H, which can also hydrogen bond to olivetolic acid carboxylate and also results in almost 100% CBGA production. Mutated to S214V also flips its binding position, resulting in 90% 5GOA. See FIG. 78.

Figure 79:
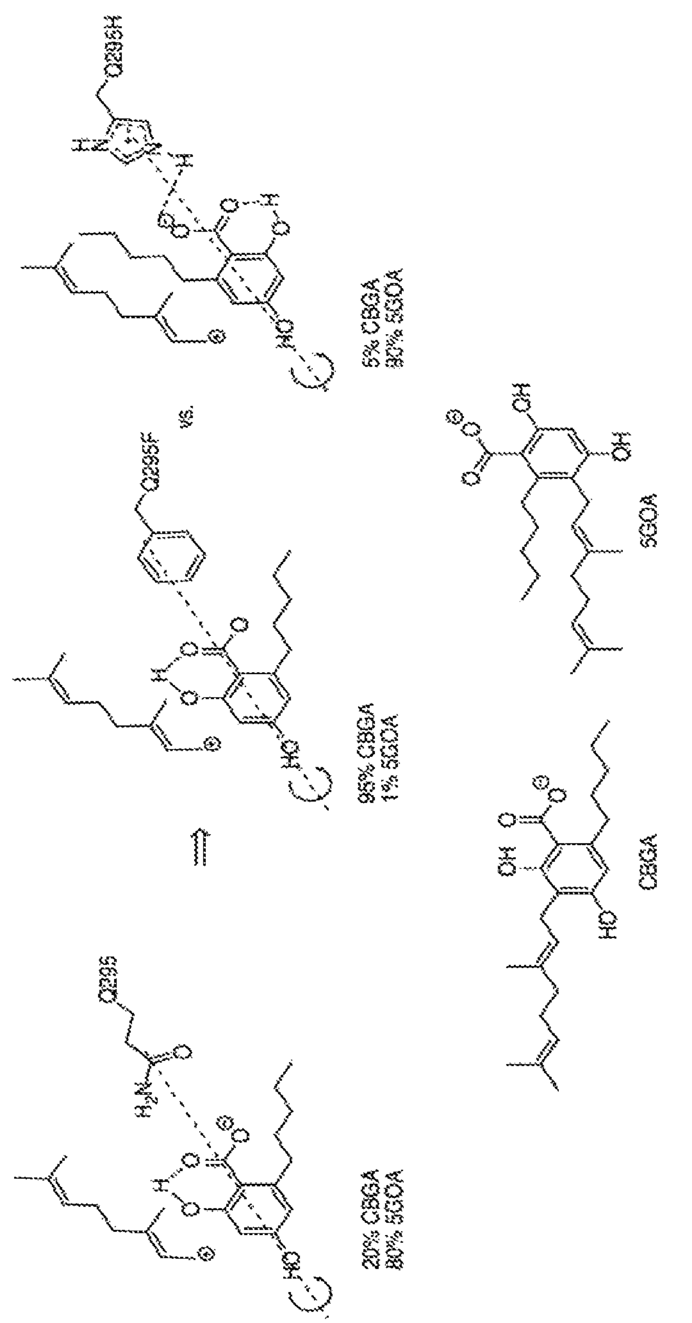
FIG. 79: Complete amino acid replacement at position Q295 in Orf2 allows a structure function mechanism for CBGA production and regiospecific prenylation.

The inventors have also discovered a ratcheting mechanism of Orf2 mutants at Q295. The Q295 can interact with both the hydrocarbon tail of olivetolic acid, as well as the hydrophobic terminus of the GPP substrate. Mutation Q295 to Q295F enhances these hydrophobic interations, leading to 98% CBGA. Alternatively mutating to Q295H forms a protonated residue, which can destabilize the hydrocarbon tail, resulting in the substrate ratcheting binding orientation. The resulting hydrogen bond with the carboxylate of olivetolic acid stabilizes the flipped binding orientation, resulting in 90% 5GOA. See FIG. 79.

Polynucleotides, Vectors and Methods

The disclosure provides isolated or purified polynucleotides that encode any one of the recombinant polypeptides disclosed herein. The disclosure provides polynucleotides comprising a nucleic acid sequence with at least about 80% identity (for instance, about 85%, about 90%, about 95%, about 96%, about 97%, about 98%, or about 99%, and inclusive of all values and subranges therebetween) to the nucleic acid sequence set forth in SEQ ID NO: 301 (ORF2); SEQ ID NO: 601 (PB005) and SEQ ID NO: 603 (PBJ).

The disclosure provides a vector comprising any one of the recombinant polynucleotide sequences disclosed herein.

The disclosure further provides a host cell comprising any one of the vectors disclosed herein; any one of the polynucleotides disclosed herein; or any one of the polynucleotides encoding the recombinant polypeptides disclosed herein. Non-limiting examples of host cells include microbial host cells, such as, for example, bacteria, *E. coli*, yeast, microalgae; non-microbial hosts, such as, for example, insect cells, mammalian cell culture, plant cultures; and whole terrestrial plants. In some aspects, expression of any one of the vectors disclosed herein; any one of the polynucleotides disclosed herein; or any one of the polynucleotides encoding the recombinant polynucleotides disclosed herein may be done ex vivo or in vitro. In some aspects, expression of any one of the vectors disclosed herein; any one of the polynucleotides disclosed herein; or any one of the recombinant polynucleotides disclosed herein may be done in cell-free systems.

The disclosure provides methods of producing any one of the recombinant polynucleotides disclosed herein, comprising culturing the host cell comprising any one of the vectors disclosed herein, in a medium permitting expression of the recombinant polynucleotide, and isolating or purifying the recombinant polynucleotide from the host cell.

It is to be understood that the description above as well as the examples that follow are intended to illustrate, and not limit, the scope of the invention. Other aspects, advantages and modifications within the scope of the invention will be apparent to those skilled in the art to which the invention pertains.

All patents, patent applications, references, and journal articles cited in this disclosure are expressly incorporated herein by reference in their entireties for all purposes.

EXAMPLES

Example 1: Methods for Generating and Studying Aromatic Prenyltransferase Variants A. Construction of a Synthesized Gene Library of n=96 Orf2 Variants with Select Amino Acid Substitutions and Other Orf2 Varaints.

DNA plasmids encoding the 96 "tripleton" variants of orf2 (orf2 variants) were ordered and delivered in the background of the T5 expression vector pD441-SR from DNA2.0 (now ATUM, catalog pD441-SR). The sequences for the 96 variants are described as SEQ ID NO: DNA_150247-DNA_150342. Each Orf2 variant contains a unique combination of three amino acid substitutions relative to the base construct (SEQ ID NO: DNA_consensus).

All variants aside from the tripleton parental variants were created using site directed mutagenesis with QuikChange® II Site-Directed Mutagenesis Kit (Agilent catalog #200523), which includes a DNA polymerase and all reagents necessary to support mutagenesis at single sites for large constructs and for use with electroporation competent cells. Standard manufacturer protocols were employed.

B. Construction of Synthesized Prenyltransferase Enzymes.

DNA plasmids encoding aromatic prenyltransferase enzymes (APTs) were ordered and delivered in the background of the T5 expression vector pD441-SR from DNA2.0 (now ATUM, catalog pD441-SR).

C. Expression and Purification of Proteins from the Synthesized Orf2 Gene Library of Orf2 Variants and Prenyltransferase Enzymes.

DNA plasmids containing each of the Orf2 variants or prenyltransferase enzymes were individually transformed into One Shot™ BL21 (DE3) chemically competent *E. coli* cells (Invitrogen catalog C600003) according to the chemically competent cell transformation protocol provided by Invitrogen. This resulted in 96 individual *E. coli* cell lines, each containing one plasmid encoding an Orf2 variant.

To induce protein expression, individual cell lines encoding each of the "orf2 variants" or "APTs" was individually inoculated into 2 milliliters LB media with 50 micrograms per milliliter of Kanamycin sulfate in 15 milliliter culture tubes and grown at 37 degrees Celsius for 16 hours with vigorous shaking. After 16 hours, each culture was diluted into 38 milliliters LB media with 50 micrograms per milliliter of Kanamycin sulfate for a total of 40 milliliters. The absorbance at 600 nm (0D600) was monitored until it reached a value of 0.6 absorbance units. When the OD600 reached a value of 0.6, then IPTG was added to each culture to a final concentration of 500 micrograms per milliliter, resulting in an "induced culture." Each "induced culture" was grown at 20 degrees Celsius with vigorous shaking for 20 hours.

After the cultures were grown under protein induction conditions, the target protein was extracted following a standard protein purification protocol. Each "induced culture" was spun at 4,000G for 5 minutes. The supernatant was discarded, leaving only a cell pellet. Each individual cell pellet was resuspended in 25 milliliters of a solution containing 20 millimolar Tris-HCL, 500 millimolar sodium chloride, 5 millimolar imidazole, and 10% glycerol ("lysis buffer"), resulting in a "cell slurry." To each individual "cell slurry", 30 microliters of 25 units per microliter Benzonase® endonuclease enzyme (Millipore, Benzonase, catalog number 70664-1), as well as 300 microliters of phosphatase and protease inhibitor (Thermo-Fisher, Halt™ Protease and Phosphatase Inhibitor Cocktail, EDTA-free, catalog number 78441) was added. Each individual "cell slurry" was then subjected to 30 second pulses of sonication, 4 times each, for a total of 120 seconds, using the Fisher Scientific Sonic Dismembrator Model 500 under 30% amplitude conditions. In between each 30 second pulse of sonication, the "cell slurry" was placed on ice for 30 seconds. After sonication, each individual "cell slurry" was centrifuged for 45 minutes at 14,000 times gravity.

Protein purification columns (Bio-Rad, Econo-Pac® Chromatography Columns, catalog number 7321010) were prepared by adding 1.5 milliliters His60 resin slurry (Takara, His60 nickel superflow resin, catalog number 635660). 5 milliliters deionized water was added to resin slurry, to agitate and rinse the resin. The columns were then uncapped and the resulting flow-through was discarded. Then, 5 milliliters deionized water was added a second time, and the resulting flow-through was discarded. Then, 10 milliliters "lysis buffer" was added to the resin, completely disturbing the resin bed, and the flow-through was discarded.

The protein purification columns were capped, and the supernatant from the "cell slurry" was added to the resin bed without disturbing the resin bed. The columns were uncapped, allowing the supernatant to pass over the resin bed. The resin was then washed 2 times with 10 milliliters of a solution containing 20 millimolar Tris-HCl, 500 millimolar sodium chloride, and 20 millimolar imidazole ("wash buffer"). The flow-through from the wash steps was discarded. The protein was then eluted off the column with 10 milliliters of a solution containing 20 millimolar Tris-HCl, 200 millimolar sodium chloride, and 250 millimolar imidazole. The eluted protein was collected and dialyzed overnight in 4 liters of a solution containing 200 millimolar Tris-HCl and 800 millimolar sodium chloride in 3.5-5.0 kilodalton dialysis tubing (Spectrum™ Spectra/Por™ dialysis tubing, catalog number 133198). After overnight dialysis, protein was concentrated to approximately 10 milligrams per milliliter using centrifugal protein filters (Millipore Amicon® Ultra-15 Ultracel® 10K, catalog number UFC901024).

C. Screening of the Orf2 Protein Variants and Aromatic Prenytransferase Enzymes for Protein Activity and Phenotypes.

The library of Orf2 variants and APTs were screened for protein expression by western blot with an anti-HIS antibody (Cell Signaling Technologies, anti-his monoclonal antibody, catalog number 23655) according to the protocol provided by Cell Signaling Technologies for the antibody. The enzymes that had detectable levels of protein expression as determined by western blot were used in a prenylation assay.

Proteins that exhibited detectable expression by Western blot were assayed for prenylation activity using a substrate (e.g. olivetolic acid, olivetol, divarinic acid, etc.) and a donor molecule (e.g. GPP, FPP, DMAPP, etc.). Unless otherwise stated, each prenylation reaction assay was performed in a volume of 20 microliters and contained 20 millimolar magnesium chloride (MgCl2), 2 millimolar donor molecule (e.g. GPP), 100 millimolar HEPES buffer at a pH of 7.5, 2 millimolar substrate (e.g. olivetolic acid), and 20 micrograms Orf2 protein, Orf2 variant protein, or APT. These reactions were incubated for 16 hours at 30° C.

The prenylated products obtained from the various reactions described in these Examples is summarized in Table C below.

TABLE C prenylated product summary

| Name of prenylated product | Prenyl transferase | Substrate | Donor | Attachment Site of the prenyl group on the substrate |
|---|---|---|---|---|
| UNK1 | Orf2 | OA | DMAPP | CO |
| UNK2 | Orf2 | OA | DMAPP | 2-O |
| UNK3 | Orf2 | OA | DMAPP | 4-O |
| RBI-08 | Orf2 | OA | DMAPP | 3-C |
| RBI-17 | Orf2 | OA | DMAPP | 5-C |
| RBI-05 | Orf2 | OA | GPP | CO |
| RBI-06 | Orf2 | OA | GPP | 2-O |
| UNK4 | Orf2 | OA | GPP | 4-O |
| RBI-02 (CBGA) | Orf2 | OA | GPP | 3-C |
| RBI-04 (5-GOA) | Orf2 | OA | GPP | 5-C |
| RBI-56 | Orl2 | OA | FPP | 2-O |
| UNK5 | Orf2 | OA | FPP | 4-O |
| RBI-14 (CBFA) | Orf2 | OA | FPP | 3-C |
| RBI-16 (5-FOA) | Orf2 | OA | FPP | 5-C |
| UNK6 | Orf2 | DVA | DMAPP | CO |
| UNK7 | Orf2 | DVA | DMAPP | 2-O |
| UNK8 | Orf2 | DVA | DMAPP | 4-O |
| UNK9 | Orf2 | DVA | DMAPP | 3-C |
| UNK10 | Orf2 | DVA | DMAPP | 5-C |
| RBI-24 | Orf2 | DVA | GPP | CO |
| RBI-28 | Orf2 | DVA | GPP | 2-O |
| UNK11 | Orf2 | DVA | GPP | 4-O |
| RBI-26 (CBGVA) | Orf2 | DVA | GPP | 3-C |
| RBI-27 | Orf2 | DVA | GPP | 5-C |
| UNK12 | Orf2 | DVA | FPP | CO |
| UNK13 | Orf2 | DVA | FPP | 2-O |
| UNK14 | Orf2 | DVA | FPP | 4-O |
| RBI-38 | Orf2 | DVA | FPP | 3-C |
| RBI-39 | Orf2 | DVA | FPP | 5-C |
| RBI-10 | Orf2 | O | DMAPP | 1-C or 5-C |
| UNK16 | Orf2 | O | DMAPP | 2-O or 4-O |
| UNK16 | Orf2 | O | DMAPP | 2-O or 4-O |
| RBI-09 | Orf2 | O | DMAPP | 3-C |
| RBI-10 | Orf2 | O | DMAPP | 1-C or 5-C |
| RBI-10 | HypSc | O | DMAPP | 1-C or 5-C |
| UNK16 | HypSc | O | DMAPP | 2-O or 4-O |
| UNK16 | HypSc | O | DMAPP | 2-O or 4-O |
| RBI-09 | HypSc | O | DMAPP | 3-C |
| RBI-10 | HypSc | O | DMAPP | 1-C or 5-C |
| RBI-10 | PB005 | O | DMAPP | 1-C or 5-C |

TABLE C-continued prenylated product summary

| Name of prenylated product | Prenyl transferase | Substrate | Donor | Attachment Site of the prenyl group on the substrate |
|---|---|---|---|---|
| UNK16 | PB005 | O | DMAPP | 2-O or 4-O |
| UNK16 | PB005 | O | DMAPP | 2-O or 4-O |
| RBI-09 | PB005 | O | DMAPP | 3-C |
| RBI-10 | PB005 | O | DMAPP | 1-C or 5-C |
| RBI-03 (5-GO) | Orf2 | O | GPP | 1-C or 5-C |
| RBI-20 | Orf2 | O | GPP | 2-O or 4-O |
| RBI-20 | Orf2 | O | GPP | 2-O or 4-O |
| RBI-01 (CBG) | Orf2 | O | GPP | 3-C |
| RBI-03 (5-GO) | Orf2 | O | GPP | 1-C or 5-C |
| RBI-15 | Orf2 | O | FPP | 1-C or 5-C |
| UNK18 | Orf2 | O | FPP | 2-O or 4-O |
| UNK18 | Orf2 | O | FPP | 4-O or 2-O |
| UNK19 | Orf2 | O | FPP | 3-C |
| RBI-15 | Orf2 | O | FPP | 1-C or 5-C |
| UNK54 | PB005 | DV | DMAPP | 1-C or 5-C |
| UNK55 | PB005 | DV | DMAPP | 2-O or 4-O |
| UNK55 | PB005 | DV | DMAPP | 2-O or 4-O |
| UNK56 | PB005 | DV | DMAPP | 3-C |
| UNK54 | PB005 | DV | DMAPP | 1-C or 5-C |
| UNK20 | Orf2 | ORA | GPP | CO |
| UNK21 | Orf2 | ORA | GPP | 2-O |
| UNK22 | Orf2 | ORA | GPP | 4-O |
| UNK23 | Orf2 | ORA | GPP | 3-C |
| UNK24 | Orf2 | ORA | GPP | 5-C |
| UNK25 | Hypsc, 064, 065, orf2, 002, 005 | ORA | DMAPP | CO |
| UNK26 | Hypsc, 064, 065, orf2 | ORA | DMAPP | 2-O |
| UNK27 | hypsc, Atapt | ORA | DMAPP | 4-O |
| UNK28 | 064, 005 | ORA | DMAPP | 3-C |
| UNK29 | orf2 | ORA | DMAPP | 5-C |
| RBI-32 | PB005 | DV | GPP | 3C |
| RBI-33 | PB005 | DV | GPP | 1-C or 5-C |
| UNK30 | Orf2 | ORA | FPP | CO |
| UNK31 | Orf2 | ORA | FPP | 2-O |
| UNK32 | Orf2 | ORA | FPP | 4-O |
| UNK33 | Orf2 | ORA | FPP | 3-C |
| UNK34 | Orf2 | ORA | FPP | 5-C |
| UNK60 | Orf2 | OA | GGPP | 3C |
| UNK61 | Orf2 | OA | GGPP | 5-C |
| UNK62 | Orf2 | ORA | GGPP | 3C |
| UNK63 | Orf2 | ORA | GGPP | 5-C |
| UNK64 | Orf2 | DVA | GGPP | 3C |
| UNK65 | Orf2 | DVA | GGPP | 5-C |
| RBI-07 | Orf2 | OA | GPP | 3-C + 5-C |
| RBI-29 | Orf2 | DVA | GPP | 3-C + 5-C |
| RBI-30 | Orf2 | DVA | GPP | 5-C + 2-O |
| RBI-36 | Orf2 | DV | GPP | 3-C + 5-C |
| UNK35 | Orf2 | DV | GPP | 5-C + 1-C |
| UNK36 | Orf2 | OA | GPP, DMAPP | 5-C (GPP) + 3-C (DMAPP) |
| RBI-22 | Orf2 | OA | GPP, DMAPP | 5-C (DMAPP) + 3-C (GPP) |
| UNK38 | Orf2 | OA | GPP, DMAPP | CO (GPP) + 3-C (DMAPP) |
| RBI-18 | Orf2 | OA | DMAPP | 5-C + 3-C |
| UNK40 | 005 + Orf2 | O | GPP, DMAPP | 5-C (GPP) + 3-C (DMAPP) |
| UNK41 | 005 + Orf2 | O | GPP, DMAPP | 5-C (DMAPP) + 3-C (GPP) |
| UNK42 | Orf2 | OA | GPP, FPP | 5-C (GPP) + 3-C (FPP) |
| RBI-12 | PB005 | O | DMAPP | 1-C + 5-C |
| RBI-11 | PB005 | O | DMAPP | 1-C + 3-C |
| UNK44 | 005 + Orf2 | O | FPP, DMAPP | 5-C (DMAPP) + 3-C (FPP) |
| UNK45 | 005 + Orf2 | O | FPP, DMAPP | 5-C (DMAPP) + 1-C (FPP) |
| UNK46 | Orf2 | O | GPP, FPP | 5-C (GPP) + 3-C (FPP) |
| UNK57 | PB005/HypSc | DV | DMAPP | 5-C + 3-C |
| UNK58 | PB005/HypSc | DV | DMAPP | 5-C + 1-C |
| UNK59 | Orf2 | ORA | GPP | 5-C + 3-C |

TABLE C-continued

| prenylated product summary | | | | |
|---|---|---|---|---|
| Name of prenylated product | Prenyl transferase | Substrate | Donor | Attachment Site of the prenyl group on the substrate |
| UNK66 | 005 + Orf2 | O | GPP, DMAPP | 5-C (DMAPP) + 1-C (GPP) |
| UNK67 | 005 + Orf2 | O | GPP, DMAPP | 5-C (DMAPP) + 1-C (DMAPP) + 3-C (GPP) |

Example 2: Generation of ORF2 Variants which Synthesize an Altered Amount of Prenylated Products when Using OA as Substrate and DMAPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position.

The wild type Orf2 prenylation reaction using OA as substrate and DMAPP as donor produces 5 products as detected by HPLC. The respective retention times of these products are approximately 3.9, 5.44, 5.57, 6.29, and 6.66 minutes.

Table 1 provides a summary of the prenylation products produced from OA and DMAPP, their retention times, and the hypothesized prenylation site on OA. FIG. 16 shows the predicted chemical structures of the respective prenylation products.

TABLE 1

| Predicted prenylation products of Orf2 or Orf2 Mutants when using OA as substrate and DMAPP as donor | | | | |
|---|---|---|---|---|
| Molecule ID | Substrate | Donor | Attachment Site | Retention Time |
| UNK1 | OA | DMAPP | CO | 3.9 |
| UNK2 | OA | DMAPP | 2-O | 6.66 |
| UNK3 | OA | DMAPP | 4-O | 6.29 |
| RBI-08 | OA | DMAPP | 3-C | 5.44 |
| RBI-17 | OA | DMAPP | 5-C | 5.57 |

Table 2 provides a summary of the analysis performed on the enzymatic activity of the ORF2 variants to produce prenylated products using Olivetolic Acid (OA) as substrate and Dimethylallyl pyrophosphate (DMAPP) as donor. Table 2 lists the mutations within each of the mutants analyzed as well mAU*min areas from the HPLC analysis of the reaction products.

TABLE 2

| HPLC Area in mAU*min of prenylation products produced by Orf2 and Orf2 Variants when using OA as substrate and DMAPP as donor | | | | | | |
|---|---|---|---|---|---|---|
| ID# | Mutations | 3.9 | 5.44 | 5.57 | 6.29 | 6.66 |
| 1 | WT | 0.0055 | 0.0809 | 0.058 | 0.0052 | 0.0193 |
| 2 | V9_Q38G_E112D_F123H | 0.0021 | 0.0901 | 0.1688 | 0.0124 | 0.0045 |
| 3 | V17_V49L_F123A_Y283L | 0.0043 | 0.0365 | 0.0163 | 0.0001 | 0.0026 |
| 4 | V25_L219F_V294N_Q295A | 0.0102 | 0.3034 | 0.0456 | 0.0004 | 0.0986 |
| 5 | V33_A17T_C25V_E112G | 0.0028 | 0.0471 | 0.0501 | 0.0007 | 0.0075 |
| 6 | V49_G205L_R228E_C230N | 0.0038 | 0.0245 | 0.0185 | 0.0008 | 0.0074 |
| 7 | V57_C25V_A232S_V271E | 0.0031 | 0.0192 | 0.0163 | 0.0002 | 0.0055 |
| 8 | V65_V49A_Q161S_V294A | 0.0125 | 0.3382 | 0.1002 | 0.0006 | 0.1914 |
| 9 | V73_V49S_K118Q_S177E | 0.0093 | 0.028 | 0.0213 | 0.0002 | 0.0089 |
| 10 | V81_V49L_D166E_L274V | 0.0037 | 0.0287 | 0.0221 | 0.001 | 0.004 |
| 11 | V89_Y121W_S177Y_G286E | 0.0009 | 0.0308 | 0.0208 | 0.0002 | 0.0067 |
| 12 | V10_V49A_S177Y_C209G | 0.0039 | 0.0203 | 0.0112 | 0.001 | 0.0086 |
| 13 | V26_A53E_A108G_K118N | 0.0031 | 0.0224 | 0.0276 | 0.0001 | 0.0055 |
| 14 | V34_A53Q_Y121W_A232S | 0.0034 | 0.0194 | 0.0162 | 0.0005 | 0.0074 |
| 15 | V42_D166E_S177Y_S214F | 0.0018 | 0.0235 | 0.011 | 0.0011 | 0.0061 |
| 16 | V58_K118Q_L174V_R228Q | 0.0036 | 0.0213 | 0.0115 | 0.0001 | 0.008 |
| 17 | V66_C25V_F213M_Y216A | 0.0019 | 0.0236 | 0.0107 | 0.0001 | 0.0077 |
| 18 | V74_M106E_Y121W_D166E | 0.0022 | 0.02 | 0.0075 | 0.0008 | 0.01 |
| 19 | V82_V49S_K119D_F213M | 0.0022 | 0.0215 | 0.0078 | 0.0003 | 0.007 |
| 20 | V90_A17T_F123W_L298A | 0.0026 | 0.0361 | 0.0189 | 0.001 | 0.008 |
| 21 | V3_V49S_M162A_Y283L | 0.0036 | 0.0354 | 0.0755 | 0.0073 | 0.0093 |
| 22 | V11_K118N_K119A_V271E | 0.003 | 0.0168 | 0.0076 | 0.001 | 0.0072 |
| 23 | V19_V49L_S214R_V271E | 0.0046 | 0.0233 | 0.0092 | 0.0001 | 0.0072 |
| 24 | V35_A53Q_S177Y_Y288H | 0.0088 | 0.0993 | 0.0948 | 0.0151 | 0.0379 |
| 25 | V43_Q161A_M162F_Q295A | 0.0149 | 0.7629 | 0.0088 | 0.0002 | 0.4698 |

TABLE 2-continued

| HPLC Area in mAU*min of prenylation products produced by Orf2 and Orf2 Variants when using OA as substrate and DMAPP as donor | | | | | | |
|---|---|---|---|---|---|---|
| ID# | Mutations | 3.9 | 5.44 | 5.57 | 6.29 | 6.66 |
| 26 | V51_V49L_K119D_G205M | 0.0042 | 0.0263 | 0.0104 | 0.0004 | 0.0113 |
| 27 | V59_V49S_S214G_V294A | 0.0067 | 0.0323 | 0.0351 | 0.0002 | 0.0048 |
| 28 | V67_A108G_K119D_L298A | 0.0026 | 0.0239 | 0.0083 | 0.001 | 0.0046 |
| 29 | V75_A53Q_L274V_Q295A | 0.004 | 0.0268 | 0.0095 | 0.0002 | 0.0101 |
| 30 | V83_E112D_L219F_V294F | 0.0066 | 0.0762 | 0.0657 | 0.0079 | 0.0132 |
| 31 | V91_N173D_F213M_V294F | 0.0014 | 0.0206 | 0.0205 | 0.001 | 0.0077 |
| 32 | V4_K118Q_Q161W_S214F | 0.0029 | 0.023 | 0.0193 | 0.0001 | 0.0086 |
| 33 | V20_D227E_C230N_Q295W | 0.0025 | 0.0281 | 0.0237 | 0.0001 | 0.0073 |
| 34 | V28_A53T_D166E_Q295W | 0.0066 | 0.095 | 0.0939 | 0.0214 | 0.0219 |
| 35 | V44_A53E_Q161A_V294N | 0.0054 | 0.1369 | 0.0624 | 0.001 | 0.0241 |
| 36 | WT | 0.001 | 0.101 | 0.066 | 0.001 | 0.013 |
| 37 | V52_K119A_S214G_L298A | 0.001 | 0.021 | 0.006 | 0.001 | 0.005 |
| 38 | V60_E112D_K119A_N173D | 0.001 | 0.019 | 0.007 | 0.001 | 0.006 |
| 39 | V68_K118N_C209G_R228Q | 0.001 | 0.02 | 0.007 | 0.001 | 0.008 |
| 40 | V76_V49A_F123A_Y288H | 0.001 | 0.021 | 0.008 | 0.001 | 0.007 |
| 41 | V84_F123H_L174V_S177E | 0.001 | 0.104 | 0.057 | 0.002 | 0.011 |
| 42 | V92_A53T_E112D_G205M | 0.003 | 0.122 | 0.141 | 0.019 | 0.028 |
| 43 | V69_A53T_M106E_Q161S | 0.001 | 0.106 | 0.056 | 0.001 | 0.014 |
| 44 | V60_E112D_K119A_N173D | 0.001 | 0.019 | 0.003 | 0.001 | 0.009 |
| 45 | V62_A53T_N173D_S214R | 0.001 | 0.024 | 0.004 | 0.001 | 0.008 |
| 46 | V70_Q38G_D166E_Q295A | 0.001 | 0.14 | 0.08 | 0.002 | 0.009 |
| 47 | V78_K119D_Q161W_L298Q | 0.001 | 0.021 | 0.006 | 0.001 | 0.007 |
| 48 | V94_A17T_V49A_C230N | 0.001 | 0.017 | 0.004 | 0.001 | 0.007 |
| 49 | V15_A53E_F213M_R228Q | 0.001 | 0.02 | 0.005 | 0.001 | 0.007 |
| 50 | V23_L219F_Y283L_L298W | 0.001 | 0.029 | 0.043 | 0.001 | 0.01 |
| 51 | V31_D227E_R228E_L298Q | 0.001 | 0.015 | 0.003 | 0.001 | 0.007 |
| 52 | V39_A53T_K118N_S214F | 0.001 | 0.026 | 0.087 | 0.001 | 0.007 |
| 53 | V47_K118Q_F123A_R228E | 0.001 | 0.016 | 0.004 | 0.001 | 0.004 |
| 54 | V55_V49S_Y216A_V294N | 0.001 | 0.017 | 0.005 | 0.001 | 0.007 |
| 55 | V63_F123W_M162F_C209G | 0.001 | 0.021 | 0.005 | 0.001 | 0.007 |
| 56 | V79_V49A_Y121W_C230S | 0.001 | 0.023 | 0.005 | 0.001 | 0.005 |
| 57 | V87_S177W_Y288H_V294N | 0.001 | 0.027 | 0.005 | 0.001 | 0.006 |
| 58 | V95_A17T_Q161W_A232S | 0.001 | 0.194 | 0.067 | 0.001 | 0.015 |
| 59 | V8_K119A_Q161A_R228Q | 0.001 | 0.029 | 0.005 | 0.001 | 0.01 |
| 60 | V16_A53Q_S177W_L219F | 0.002 | 0.093 | 0.069 | 0.003 | 0.007 |
| 61 | V32_M162A_C209G_Y288H | 0.001 | 0.035 | 0.007 | 0.001 | 0.008 |
| 62 | V40_S177E_S214R_R228E | 0.001 | 0.031 | 0.007 | 0.001 | 0.009 |
| 63 | V48_V49L_E112D_G286E | 0.001 | 0.024 | 0.006 | 0.001 | 0.007 |
| 64 | V56_F123A_M162F_S214G | 0.002 | 0.038 | 0.046 | 0.005 | 0.01 |
| 65 | V72_E112G_G205M_L298W | 0.001 | 0.061 | 0.163 | 0.033 | 0.007 |
| 66 | V80_M162A_N173D_S214F | 0.002 | 0.028 | 0.012 | 0.001 | 0.007 |
| 67 | V88_A108G_Q161S_G205M | 0.001 | 0.04 | 0.087 | 0.001 | 0.007 |
| 68 | WT | 0.001 | 0.076 | 0.047 | 0.002 | 0.017 |
| 69 | Q38G_D166E | 0.001 | 0.039 | 0.031 | 0.001 | 0.009 |
| 70 | Q38G_Q295A | 0.001 | 0.1 | 0.062 | 0.004 | 0.02 |
| 71 | D166E_Q295A | 0.001 | 0.049 | 0.011 | 0.001 | 0.018 |
| 72 | L219F_V294N | 0.002 | 0.147 | 0.074 | 0.003 | 0.034 |
| 73 | L219F_Q295A | 0.003 | 0.114 | 0.013 | 0.001 | 0.048 |
| 74 | V294N_Q295A | 0.003 | 0.257 | 0.111 | 0.009 | 0.057 |
| 75 | A53Q_S177W | 0.001 | 0.149 | 0.059 | 0.001 | 0.017 |
| 76 | A53Q_L219F | 0.001 | 0.069 | 0.056 | 0.003 | 0.017 |
| 77 | S177W_L219F | 0.001 | 0.068 | 0.062 | 0.001 | 0.009 |
| 78 | A108G_Q161S | 0.001 | 0.038 | 0.123 | 0.001 | 0.007 |
| 79 | A108G_G205M | 0.001 | 0.031 | 0.031 | 0.001 | 0.006 |
| 80 | Q161S_G205M | 0.001 | 0.089 | 0.028 | 0.001 | 0.021 |
| 81 | F123H_L174V | 0.002 | 0.101 | 0.113 | 0.006 | 0.007 |
| 82 | F123H_S177E | 0.001 | 0.188 | 0.106 | 0.001 | 0.007 |
| 83 | L174V_S177E | 0.002 | 0.096 | 0.046 | 0.001 | 0.012 |
| 84 | A53T_D166E | 0.001 | 0.051 | 0.061 | 0.004 | 0.01 |
| 85 | A53T_Q295W | 0.008 | 0.459 | 0.307 | 0.104 | 0.09 |
| 86 | D166E_Q295W | 0.002 | 0.107 | 0.064 | 0.007 | 0.021 |
| 87 | A53Q_S177Y | 0.001 | 0.059 | 0.05 | 0.004 | 0.002 |
| 88 | A53Q_Y288H | 0.013 | 0.2 | 0.099 | 0.018 | 0.13 |
| 89 | S177Y_Y288H | 0.002 | 0.059 | 0.033 | 0.003 | 0.024 |
| 90 | V49A_Q161S | 0.003 | 0.146 | 0.045 | 0.001 | 0.065 |
| 91 | V49A_V294A | 0.002 | 0.094 | 0.04 | 0.003 | 0.059 |
| 92 | Q161S_V294A | 0.009 | 0.479 | 0.103 | 0.001 | 0.091 |
| 93 | A53T_M106E | 0.001 | 0.077 | 0.073 | 0.007 | 0.014 |
| 94 | A53T_Q161S | 0.005 | 0.348 | 0.116 | 0.002 | 0.06 |
| 95 | M106E_Q161S | 0.001 | 0.06 | 0.028 | 0.001 | 0.011 |
| 96 | A53T_K118N | 0.001 | 0.023 | 0.018 | 0.001 | 0.002 |
| 97 | A53T_S214F | 0.001 | 0.18 | 0.296 | 0.024 | 0.01 |
| 98 | K118N_S214F | 0.001 | 0.024 | 0.047 | 0.001 | 0.01 |
| 99 | WT | 0.002 | 0.082 | 0.056 | 0.001 | 0.018 |
| 100 | A108G | 0.001 | 0.035 | 0.162 | 0.001 | 0.007 |

TABLE 2-continued

HPLC Area in mAU*min of prenylation products produced by Orf2 and Orf2 Variants when using OA as substrate and DMAPP as donor

| ID# | Mutations | 3.9 | 5.44 | 5.57 | 6.29 | 6.66 |
|---|---|---|---|---|---|---|
| 101 | A53Q | 0.001 | 0.072 | 0.056 | 0.002 | 0.017 |
| 102 | A53T | 0.004 | 0.183 | 0.16 | 0.02 | 0.031 |
| 103 | D166E | 0.001 | 0.05 | 0.051 | 0.001 | 0.007 |
| 104 | F123H | 0.002 | 0.106 | 0.153 | 0.01 | 0.006 |
| 105 | G205M | 0.001 | 0.072 | 0.046 | 0.003 | 0.014 |
| 106 | K118N | 0.001 | 0.027 | 0.03 | 0.001 | 0.005 |
| 107 | L219F | 0.001 | 0.07 | 0.059 | 0.001 | 0.015 |
| 108 | M106E | 0.001 | 0.051 | 0.036 | 0.001 | 0.008 |
| 109 | Q161S | 0.003 | 0.204 | 0.076 | 0.001 | 0.03 |
| 110 | Q295A | 0.01 | 0.308 | 0.029 | 0.002 | 0.128 |
| 111 | Q295W | 0.017 | 0.894 | 0.361 | 0.069 | 0.171 |
| 112 | Q38G | 0.001 | 0.064 | 0.047 | 0.001 | 0.014 |
| 113 | S177E | 0.002 | 0.13 | 0.066 | 0.001 | 0.016 |
| 114 | S177W | 0.001 | 0.089 | 0.059 | 0.001 | 0.013 |
| 115 | S177Y | 0.001 | 0.069 | 0.06 | 0.001 | 0.012 |
| 116 | S214F | 0.001 | 0.049 | 0.072 | 0.001 | 0.005 |
| 117 | V294A | 0.006 | 0.218 | 0.104 | 0.006 | 0.051 |
| 118 | V294N | 0.003 | 0.171 | 0.071 | 0.003 | 0.039 |
| 119 | V49A | 0.003 | 0.05 | 0.025 | 0.001 | 0.017 |
| 120 | Y288H | 0.005 | 0.095 | 0.034 | 0.001 | 0.053 |
| 121 | Q161D | 0.002 | 0.093 | 0.038 | 0.001 | 0.013 |
| 122 | Q161P | 0.001 | 0.046 | 0.036 | 0.001 | 0.011 |
| 123 | Q161W | 0.001 | 0.055 | 0.061 | 0.001 | 0.008 |
| 124 | A53I | 0.002 | 0.072 | 0.045 | 0.001 | 0.008 |
| 125 | A53R | 0.002 | 0.04 | 0.03 | 0.001 | 0.007 |
| 126 | A53T | 0.003 | 0.188 | 0.169 | 0.021 | 0.031 |
| 127 | A53W | 0.001 | 0.024 | 0.013 | 0.001 | 0.005 |
| 128 | V64_M106E_M162A_Y216A | 0.001 | 0.017 | 0.008 | 0.001 | 0.006 |
| 129 | WT | 0.001 | 0.092 | 0.067 | 0.003 | 0.014 |
| 130 | WT | 0.002 | 0.079 | 0.051 | 0.003 | 0.018 |
| 131 | Q295Q | 0.002 | 0.079 | 0.051 | 0.003 | 0.018 |
| 132 | Q295C | 0.018 | 0.855 | 0.03 | 0.019 | 0.543 |
| 133 | Q295E | 0.001 | 0.064 | 0.018 | 0.001 | 0.01 |
| 134 | Q295F | 0.074 | 3.511 | 0.096 | 0.016 | 1.113 |
| 135 | Q295G | 0.007 | 0.381 | 0.086 | 0.002 | 0.131 |
| 136 | Q295H | 0.007 | 0.208 | 0.162 | 0.025 | 0.054 |
| 137 | Q295I | 0.025 | 1.125 | 0.033 | 0.002 | 0.671 |
| 138 | Q295L | 0.033 | 1.618 | 0.039 | 0.005 | 0.616 |
| 139 | Q295M | 0.043 | 2.088 | 0.087 | 0.015 | 0.592 |
| 140 | Q295N | 0.002 | 0.143 | 0.029 | 0.001 | 0.041 |
| 141 | Q295P | 0.001 | 0.049 | 0.013 | 0.001 | 0.012 |
| 142 | Q295R | 0.001 | 0.011 | 0.008 | 0.001 | 0.005 |
| 143 | Q295S | 0.003 | 0.173 | 0.031 | 0.001 | 0.049 |
| 144 | Q295T | 0.002 | 0.094 | 0.016 | 0.001 | 0.032 |
| 145 | Q295V | 0.019 | 0.739 | 0.036 | 0.003 | 0.269 |
| 146 | Q295W | 0.014 | 0.889 | 0.329 | 0.107 | 0.21 |
| 147 | A53T_V294A | 0.009 | 0.663 | 0.489 | 0.081 | 0.141 |
| 148 | A53T_Q161S_V294A | 0.013 | 1.132 | 0.306 | 0.005 | 0.188 |
| 149 | A53T_Q161S_V294N | 0.009 | 0.903 | 0.244 | 0.004 | 0.15 |
| 150 | A53T_Q295A | 0.01 | 0.344 | 0.06 | 0.009 | 0.141 |
| 151 | Q161S_V294A_Q295A | 0.052 | 2.369 | 0.223 | 0.006 | 0.539 |
| 152 | A53T_Q161S_Q295A | 0.022 | 1.181 | 0.136 | 0.004 | 0.33 |
| 153 | A53T_V294A_Q295A | 0.045 | 1.216 | 0.161 | 0.052 | 0.402 |
| 154 | A53T_Q161S_V294A_Q295A | 0.056 | 2.603 | 0.308 | 0.011 | 0.539 |
| 155 | A53T_Q161S_V294N_Q295A | 0.03 | 2.286 | 0.351 | 0.009 | 0.377 |
| 156 | A53T_Q295W | 0.015 | 0.831 | 0.543 | 0.171 | 0.166 |
| 157 | Q161S_V294A_Q295W | 0.026 | 1.165 | 0.307 | 0.016 | 0.246 |
| 158 | A53T_Q161S_Q295W | 0.024 | 1.157 | 0.33 | 0.028 | 0.208 |
| 159 | A53T_V294A_Q295W | 0.014 | 0.716 | 0.455 | 0.117 | 0.141 |
| 160 | A53T_Q161S_V294A_Q295W | 0.021 | 1.042 | 0.332 | 0.026 | 0.19 |
| 161 | A53T_Q161S_V294N_Q295W | 0.024 | 1.173 | 0.365 | 0.018 | 0.215 |
| 162 | WT | 0.001 | 0.094 | 0.066 | 0.004 | 0.018 |
| 163 | S214K | 0.001 | 0.078 | 0.05 | 0.001 | 0.01 |
| 164 | Q161A | 0.001 | 0.101 | 0.053 | 0.003 | 0.021 |
| 165 | Q161H | 0.028 | 1.693 | 0.06 | 0.001 | 0.507 |
| 166 | Q161K | 0.001 | 0.043 | 0.05 | 0.011 | 0.005 |
| 167 | A53F | 0.001 | 0.015 | 0.006 | 0.001 | 0.007 |
| 168 | S177W_Q295A | 0.03 | 6.53 | 0.024 | 0.001 | 1.194 |
| 169 | S177W_S214R | 0.001 | 0.166 | 0.01 | 0.001 | 0.052 |
| 170 | Q161S_S177W | 0.001 | 0.143 | 0.028 | 0.001 | 0.019 |
| 171 | A53T_S177W | 0.001 | 0.157 | 0.108 | 0.004 | 0.02 |
| 172 | V49A_Q295L | 0.006 | 0.093 | 0.009 | 0.001 | 0.025 |
| 173 | V49A_S214R | 0.001 | 0.08 | 0.008 | 0.001 | 0.04 |
| 174 | A53T_Q295F | 0.078 | 2.46 | 0.113 | 0.035 | 0.864 |
| 175 | A53T_S214R | 0.007 | 1.158 | 0.042 | 0.001 | 0.306 |

TABLE 2-continued

HPLC Area in mAU*min of prenylation products produced by Orf2 and Orf2 Variants when using OA as substrate and DMAPP as donor

| ID# | Mutations | 3.9 | 5.44 | 5.57 | 6.29 | 6.66 |
|---|---|---|---|---|---|---|
| 176 | A53T_A161S | 0.008 | 0.524 | 0.2 | 0.004 | 0.085 |
| 177 | Q161S_Q295F | 0.086 | 3.918 | 0.096 | 0.003 | 1.178 |
| 178 | Q161S_Q295L | 0.088 | 4.011 | 0.086 | 0.025 | 1.18 |
| 179 | Q16S_S214R | 0.001 | 0.236 | 0.035 | 0.001 | 0.064 |
| 180 | S214R_Q295F | 0.126 | 5.266 | 0.02 | 0.002 | 3.086 |
| 181 | WT | 0.001 | 0.064 | 0.043 | 0.003 | 0.016 |
| 182 | WT | 0.001 | 0.064 | 0.043 | 0.003 | 0.016 |
| 183 | S214D | 0.002 | 0.079 | 0.035 | 0.001 | 0.013 |
| 184 | S214E | 0.001 | 0.224 | 0.291 | 0.003 | 0.009 |
| 185 | S214F | 0.001 | 0.042 | 0.067 | 0.002 | 0.009 |
| 186 | S214H | 0.003 | 0.651 | 0.022 | 0.001 | 0.204 |
| 187 | S214I | 0.001 | 0.043 | 0.051 | 0.001 | 0.012 |
| 188 | S214L | 0.001 | 0.024 | 0.049 | 0.001 | 0.004 |
| 189 | S214M | 0.001 | 0.047 | 0.071 | 0.002 | 0.008 |
| 190 | S214N | 0.001 | 0.026 | 0.022 | 0.001 | 0.005 |
| 191 | S214R | 0.001 | 0.292 | 0.018 | 0.001 | 0.086 |
| 192 | S214T | 0.001 | 0.06 | 0.039 | 0.001 | 0.018 |
| 193 | S214V | 0.001 | 0.044 | 0.031 | 0.001 | 0.016 |
| 194 | S214W | 0.001 | 0.075 | 0.044 | 0.001 | 0.007 |
| 195 | S214Y | 0.001 | 0.062 | 0.169 | 0.003 | 0.011 |
| 196 | Q161G | 0.001 | 0.048 | 0.035 | 0.001 | 0.01 |
| 197 | Q161N | 0.001 | 0.047 | 0.038 | 0.001 | 0.013 |
| 198 | Q161Q | 0.001 | 0.053 | 0.036 | 0.002 | 0.016 |
| 199 | A53M | 0.002 | 0.083 | 0.058 | 0.006 | 0.022 |
| 200 | A53N | 0.001 | 0.025 | 0.017 | 0.001 | 0.009 |
| 201 | A53S | 0.001 | 0.078 | 0.059 | 0.004 | 0.001 |
| 202 | A53V | 0.005 | 0.178 | 0.091 | 0.006 | 0.036 |
| 203 | V24_A17T_F213M_S214R | 0.001 | 0.111 | 0.005 | 0.001 | 0.035 |
| 204 | A53G | 0.001 | 0.029 | 0.026 | 0.001 | 0.005 |
| 205 | R228E | 0.001 | 0.01 | 0.004 | 0.001 | 0.005 |
| 206 | WT | 0.001 | 0.073 | 0.053 | 0.002 | 0.019 |
| 207 | Q161C | 0.001 | 0.138 | 0.095 | 0.002 | 0.025 |
| 208 | Q161F | 0.001 | 0.18 | 0.108 | 0.004 | 0.045 |
| 209 | Q161I | 0.002 | 0.115 | 0.076 | 0.005 | 0.034 |
| 210 | Q161L | 0.001 | 0.17 | 0.088 | 0.009 | 0.048 |
| 211 | Q161L | 0.001 | 0.128 | 0.067 | 0.004 | 0.037 |
| 212 | Q161M | 0.003 | 0.13 | 0.099 | 0.002 | 0.044 |
| 213 | Q161R | 0.001 | 0.335 | 0.033 | 0.001 | 0.04 |
| 214 | Q161S | 0.002 | 0.124 | 0.05 | 0.001 | 0.024 |
| 215 | Q161T | 0.001 | 0.116 | 0.05 | 0.001 | 0.025 |
| 216 | Q161Y | 0.16 | 1.608 | 0.262 | 0.003 | 0.258 |
| 217 | A53D | 0.001 | 0.039 | 0.033 | 0.001 | 0.011 |
| 218 | A53E | 0.001 | 0.011 | 0.007 | 0.001 | 0.005 |
| 219 | A53K | 0.001 | 0.073 | 0.063 | 0.007 | 0.016 |
| 220 | A53L | 0.005 | 0.13 | 0.078 | 0.015 | 0.029 |
| 221 | A53Q | 0.001 | 0.068 | 0.059 | 0.005 | 0.017 |
| 222 | A53Y | 0.001 | 0.016 | 0.006 | 0.001 | 0.008 |
| 223 | WT | 0.001 | 0.069 | 0.049 | 0.002 | 0.017 |
| 224 | V36_F123H_L274V_L298A | 0.001 | 0.015 | 0.017 | 0.001 | 0.006 |
| 225 | Q295D | 0.013 | 0.547 | 0.086 | 0.002 | 0.142 |
| 226 | Q295K | 0.001 | 0.082 | 0.032 | 0.001 | 0.02 |
| 227 | S214P | 0.001 | 0.012 | 0.005 | 0.001 | 0.007 |
| 228 | A53P | 0.001 | 0.011 | 0.011 | 0.001 | 0.007 |
| 229 | WT | 0.031 | 0.066 | 0.048 | 0.004 | 0.012 |
| 230 | K118Q | 0.074 | 0.027 | 0.064 | 0.004 | 0.008 |
| 231 | K119Q | 0.029 | 0.012 | 0.005 | 0.001 | 0.003 |
| 232 | M162A | 0.025 | 0.191 | 1.105 | 0.284 | 0.033 |
| 233 | K119D | 0.035 | 0.091 | 0.064 | 0.003 | 0.02 |
| 234 | F123A | 0.023 | 0.148 | 0.12 | 0.017 | 0.006 |
| 235 | K118N | 0.02 | 0.018 | 0.038 | 0.001 | 0.003 |
| 236 | Q161W | 0.096 | 0.052 | 0.072 | 0.001 | 0.003 |
| 237 | D227E | 0.034 | 0.052 | 0.056 | 0.004 | 0.008 |
| 238 | L274V | 0.029 | 0.02 | 0.013 | 0.001 | 0.009 |
| 239 | S214G | 0.033 | 0.041 | 0.265 | 0.048 | 0.006 |
| 240 | Y216A | 0.033 | 0.01 | 0.005 | 0.001 | 0.003 |
| 241 | F123W | 0.031 | 0.011 | 0.006 | 0.001 | 0.001 |
| 242 | V271E | 0.034 | 0.01 | 0.004 | 0.001 | 0.001 |
| 243 | N173D | 0.041 | 0.01 | 0.004 | 0.001 | 0.001 |
| 244 | R228Q | 0.024 | 0.01 | 0.005 | 0.001 | 0.001 |
| 245 | M162F | 0.028 | 0.044 | 0.018 | 0.001 | 0.01 |
| 246 | A232S | 0.03 | 0.385 | 0.054 | 0.001 | 0.115 |
| 247 | C230S | 0.021 | 0.024 | 0.018 | 0.001 | 0.005 |
| 248 | V294F | 0.032 | 0.052 | 0.039 | 0.006 | 0.009 |
| 249 | Y283L | 0.027 | 0.057 | 0.031 | 0.003 | 0.008 |
| 250 | S214R | 0.026 | 0.513 | 0.03 | 0.001 | 0.148 |

TABLE 2-continued

HPLC Area in mAU*min of prenylation products produced by Orf2 and Orf2 Variants when using OA as substrate and DMAPP as donor

| ID# | Mutations | 3.9 | 5.44 | 5.57 | 6.29 | 6.66 |
|---|---|---|---|---|---|---|
| 251 | G286E | 0.033 | 0.012 | 0.002 | 0.001 | 0.009 |
| 252 | S214A | 0.001 | 0.03 | 0.046 | 0.006 | 0.009 |
| 253 | S214A | 0.001 | 0.038 | 0.053 | 0.01 | 0.021 |
| 254 | S214G | 0.0009 | 0.0428 | 0.2804 | 0.0536 | 0.007 |
| 255 | S214Q | 0.0023 | 0.1456 | 0.1448 | 0.0018 | 0.0052 |
| 256 | Q161E | 0.0062 | 0.0477 | 0.032 | 0.0009 | 0.0134 |
| 257 | Q161V | 0.0011 | 0.0754 | 0.0588 | 0.0019 | 0.0188 |
| 258 | A53C | 0.0031 | 0.0791 | 0.0544 | 0.0007 | 0.0183 |
| 259 | WT | 0.001 | 0.065 | 0.047 | 0.005 | 0.016 |

The amount of each prenylation product was measured by HPLC. FIG. 1 shows a heatmap of the HPLC areas of each prenylation product generated using OA as substrate and DMAPP as donor. Each column represents a single prenylation product and each row represents an Orf2 or Orf2 variant. Prenylation products are labeled by retention time. Enzyme variants are labeled by ID #as listed in Table 2.

Example 3: Generation of ORF2 Variants which Synthesize an Altered Amount of Prenylated Products when Using OA as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position.

The wild type Orf2 prenylation reaction using OA as substrate and GPP as donor produces 6 products as detected by HPLC. The respective retention times of these products are approximately 6.14, 7.03 [CBGA], 7.27 [5-GOA], 8.17, 8.77, and 11.6 minutes.

Table 3 provides a summary of the prenylation products produced from OA and GPP, their retention times, and the hypothesized prenylation site on OA. FIG. 17 shows the predicted chemical structures of the respective prenylation products.

TABLE 3

Predicted prenylation products of Orf2 or Orf2 Mutants when using OA as substrate and GPP as donor

| Molecule ID | Substrate | Donor | Attachment Site | Retention Time |
|---|---|---|---|---|
| RBI-05 | OA | GPP | CO | 6.14 |
| RBI-06 | OA | GPP | 2-O | 8.77 |
| UNK4 | OA | GPP | 4-O | 8.17 |
| RBI-02 (CBGA) | OA | GPP | 3-C | 7.03 |
| RBI-04 (5-GOA) | OA | GPP | 5-C | 7.27 |
| RBI-07 | OA | GPP | 3-C + 5-C | 11.6 |

Table 4 provides a summary of the analysis performed on the enzymatic activity of the ORF2 variants to produce prenylated products using OA as substrate and GPP as donor. Table 4 lists the mutations within each of the mutants analyzed as well mAU*min areas from the HPLC analysis of the reaction products.

TABLE 4

HPLC Area in mAU*min of prenylation products produced by Orf2 and Orf2 Variants when using OA as substrate and GPP as donor

| ID# | Mutations | 6.14 | CBGA | 5-GOA | 8.17 | 8.77 | 11.6 |
|---|---|---|---|---|---|---|---|
| 1 | WT | 0.2794 | 7.9349 | 13.7212 | 1.0323 | 0.4271 | 1.9618 |
| 2 | V9_Q38G_E112D_F123H | 0.1061 | 1.0302 | 5.2532 | 0.1011 | 0.073 | 0.2181 |
| 3 | V17_V49L_F123A_Y283L | 0.07 | 0.1966 | 0.076 | 0.0238 | 0.0048 | 0.0002 |
| 4 | V25_L219F_V294N_Q295A | 0.3916 | 12.2815 | 1.9643 | 1.4293 | 0.7139 | 0.4415 |
| 5 | V33_A17T_C25V_E112G | 0.2338 | 3.6625 | 10.4026 | 0.641 | 1.8779 | 0.4371 |
| 6 | V49_G205L_R228E_C230N | 0.044 | 0.0786 | 0.0978 | 0.0086 | 0.0205 | 0.011 |
| 7 | V57_C25V_A232S_V271E | 0.0533 | 0.1055 | 0.034 | 0.0244 | 0.005 | 0.0005 |
| 8 | V65_V49A_Q161S_V294A | 0.9607 | 12.1374 | 7.434 | 1.8802 | 1.6359 | 0.6581 |
| 9 | V73_V49S_K118Q_S177E | 2.4814 | 1.454 | 0.7051 | 0.0547 | 0.8276 | 0.0316 |
| 10 | V81_V49L_D166E_L274V | 0.0656 | 0.1064 | 0.0287 | 0.0092 | 0.0079 | 0.0012 |
| 11 | V89_Y121W_S177Y_G286E | 0.0507 | 0.0455 | 0.0225 | 0.0049 | 0.0018 | 0.0008 |
| 12 | WT | 0.2572 | 6.3536 | 10.0533 | 0.7506 | 0.2991 | 1.4653 |
| 13 | V52_K119A_S214G_L298A | 0.0832 | 0.1415 | 10.2648 | 0.0255 | 0.0235 | 0.1171 |
| 14 | V60_E112D_K119A_N173D | 0.0392 | 0.0151 | 0.0781 | 0.0009 | 0.0001 | 0.0023 |

TABLE 4-continued

HPLC Area in mAU*min of prenylation products produced by Orf2 and Orf2 Variants when using OA as substrate and GPP as donor

| ID# | Mutations | 6.14 | CBGA | 5-GOA | 8.17 | 8.77 | 11.6 |
|---|---|---|---|---|---|---|---|
| 15 | V68_K118N_C209G_R228Q | 0.0709 | 0.034 | 0.0426 | 0.0009 | 0.001 | 0.0003 |
| 16 | V76_V49A_F123A_Y288H | 0.062 | 0.0381 | 0.0229 | 0.0021 | 0.0018 | 0.0023 |
| 17 | V84_F123H_L174V_S177E | 0.3055 | 2.1758 | 0.6027 | 0.1708 | 0.0502 | 0.0747 |
| 18 | V92_A53T_E112D_G205M | 0.3547 | 5.2677 | 35.928 | 1.2267 | 0.5641 | 3.3962 |
| 19 | V69_A53T_M106E_Q161S | 0.6502 | 19.6975 | 7.6006 | 1.7073 | 0.3979 | 2.796 |
| 20 | V60_E112D_K119A_N173D | 0.0561 | 0.253 | 0.1639 | 0.0251 | 0.039 | 0.0315 |
| 21 | V62_A53T_N173D_S214R | 0.1688 | 2.6452 | 0.0297 | 0.9909 | 0.0003 | 0.0071 |
| 22 | V70_Q38G_D166E_Q295A | 0.4737 | 3.4776 | 0.7322 | 0.2353 | 0.0732 | 0.1125 |
| 23 | WT | 0.2827 | 7.1705 | 11.5331 | 0.8652 | 0.3439 | 1.3876 |
| 24 | Q295A | 1.45 | 30.5523 | 5.1674 | 3.4945 | 0.5593 | 2.9359 |
| 25 | V10_V49A_S177Y_C209G | 0.0758 | 0.096 | 0.0479 | 0.0079 | 0.08 | 0.0294 |
| 26 | V26_A53E_A108G_K118N | 0.0828 | 0.0789 | 0.08 | 0.0073 | 0.0056 | 0.005 |
| 27 | V34_A53Q_Y121W_A232S | 0.0836 | 0.074 | 0.0259 | 0.0057 | 0.0026 | 0.0009 |
| 28 | V42_D166E_S177Y_S214F | 0.0795 | 0.0941 | 0.0515 | 0.01 | 0.0055 | 0.0012 |
| 29 | V58_K118Q_L174V_R228Q | 0.0903 | 0.1705 | 0.2533 | 0.0174 | 0.01 | 0.0003 |
| 30 | V66_C25V_F213M_Y216A | 0.0811 | 0.3019 | 0.3944 | 0.056 | 0.0145 | 0.0043 |
| 31 | V74_M106E_Y121W_D166E | 0.0881 | 0.1227 | 0.0352 | 0.013 | 0.0097 | 0.0005 |
| 32 | V82_V49S_K119D_F213M | 0.076 | 0.1102 | 0.0306 | 0.0102 | 0.0053 | 0.0002 |
| 33 | V90_A17T_F123W_L298A | 0.0817 | 0.4756 | 0.9124 | 0.1185 | 0.0793 | 0.0155 |
| 34 | V3_V49S_M162A_Y283L | 0.1636 | 0.3405 | 4.5126 | 0.0373 | 0.0566 | 0.1002 |
| 35 | V11_K118N_K119A_V271E | 0.0805 | 0.1113 | 0.0375 | 0.0128 | 0.0126 | 0.0053 |
| 36 | V19_V49L_S214R_V271E | 0.0788 | 0.1846 | 0.037 | 0.0157 | 0.0098 | 0.0023 |
| 37 | V35_A53Q_S177Y_Y288H | 1.633 | 8.8464 | 2.5998 | 1.1577 | 1.0822 | 0.1161 |
| 38 | V43_Q161A_M162F_Q295A | 0.2118 | 3.5161 | 1.2921 | 0.8034 | 0.1313 | 0.045 |
| 39 | V51_V49L_K119D_G205M | 0.0824 | 0.1206 | 0.0388 | 0.0144 | 0.0043 | 0.0013 |
| 40 | V59_V49S_S214G_V294A | 3.2839 | 1.4838 | 4.583 | 0.0931 | 0.3677 | 0.1361 |
| 41 | V67_A108G_K119D_L298A | 0.1131 | 0.1369 | 0.1136 | 0.013 | 0.0139 | 0.001 |
| 42 | V75_A53Q_L274V_Q295A | 0.0825 | 0.597 | 0.1642 | 0.0681 | 0.0231 | 0.0037 |
| 43 | V83_E112D_L219F_V294F | 0.2227 | 3.6877 | 11.4492 | 0.4814 | 0.2136 | 0.7145 |
| 44 | V91_N173D_F213M_V294F | 0.0663 | 0.1974 | 10.3487 | 0.0444 | 0.0166 | 0.2421 |
| 45 | V4_K118Q_Q161W_S214F | 0.0797 | 0.363 | 0.3916 | 0.0553 | 0.0124 | 0.002 |
| 46 | V20_D227E_C230N_Q295W | 0.1509 | 1.0926 | 0.3784 | 0.3591 | 0.0298 | 0.01 |
| 47 | V28_A53T_D166E_Q295W | 0.8082 | 10.436 | 6.5108 | 1.9787 | 0.2202 | 0.9405 |
| 48 | V44_A53E_Q161A_V294N | 0.0887 | 1.723 | 25.4591 | 0.4753 | 0.1107 | 1.1284 |
| 49 | WT | 0.2425 | 6.4286 | 10.4623 | 0.6951 | 0.2566 | 0.5593 |
| 50 | WT | 0.2499 | 5.874 | 8.9833 | 0.6112 | 0.2655 | 0.6241 |
| 51 | V78_K119D_Q161W_L298Q | 0.0685 | 0.1699 | 0.0603 | 0.0033 | 0.0131 | 0.0136 |
| 52 | V94_A17T_V49A_C230N | 0.0987 | 0.1648 | 0.1333 | 0.0023 | 0.1625 | 0.0055 |
| 53 | V15_A53E_F213M_R228Q | 0.0718 | 0.2147 | 4.5314 | 0.0244 | 0.0191 | 0.0586 |
| 54 | V23_L219F_Y283L_L298W | 0.0866 | 1.0864 | 8.9357 | 0.1104 | 0.0763 | 0.2369 |
| 55 | V31_D227E_R228E_L298Q | 0.0556 | 0.0592 | 0.0855 | 0.0872 | 0.02 | 0.0069 |
| 56 | V39_A53T_K118N_S214F | 0.0526 | 2.2095 | 3.9318 | 0.0648 | 0.0048 | 0.0547 |
| 57 | V47_K118Q_F123A_R228E | 0.0604 | 0.0776 | 0.078 | 0.0067 | 0.007 | 0.0001 |
| 58 | V55_V49S_Y216A_V294N | 0.4959 | 1.9114 | 0.4928 | 0.1476 | 0.1559 | 0.0087 |
| 59 | V71_M106E_G205L_C209G | 0.0518 | 0.0997 | 0.0249 | 0.0092 | 0.0086 | 0.0033 |
| 60 | V79_V49A_Y121W_C230S | 0.0694 | 0.0708 | 0.0208 | 0.0033 | 0.0074 | 0.0026 |
| 61 | V87_S177W_Y288H_V294N | 0.0725 | 0.5522 | 0.0445 | 0.0868 | 0.0123 | 0.0062 |
| 62 | V95_A17T_Q161W_A232S | 0.4328 | 23.1993 | 0.9315 | 1.8941 | 0.9875 | 0.0966 |
| 63 | V8_K119A_Q161A_R228Q | 0.0647 | 0.2165 | 0.1833 | 0.0196 | 0.0156 | 0.0033 |
| 64 | V16_A53Q_S177W_L219F | 0.2639 | 12.9917 | 1.637 | 0.3433 | 0.1857 | 0.3446 |
| 65 | V32_M162A_C209G_Y288H | 0.0692 | 0.2351 | 0.2343 | 0.0444 | 0.0204 | 0.0111 |
| 66 | V40_S177E_S214R_R228E | 0.071 | 0.1508 | 0.0335 | 0.0153 | 0.0086 | 0.0041 |
| 67 | V48_V49L_E112D_G286E | 0.0628 | 0.2671 | 0.0386 | 0.0575 | 0.0892 | 0.0026 |
| 68 | V56_F123A_M162F_S214G | 0.0895 | 0.1889 | 2.8827 | 0.0324 | 0.022 | 0.0303 |
| 69 | V72_E112G_G205M_L298W | 0.1442 | 1.6029 | 20.1789 | 0.174 | 0.248 | 0.6997 |
| 70 | V80_M162A_N173D_S214F | 0.0491 | 0.7197 | 5.9863 | 0.3816 | 0.0261 | 0.0878 |
| 71 | V88_A108G_Q161S_G205M | 0.35 | 7.8534 | 4.4162 | 1.0133 | 0.4621 | 0.549 |
| 72 | WT | 0.2595 | 7.5193 | 13.3225 | 0.8722 | 0.3068 | 0.6495 |
| 73 | Q38G_D166E | 0.1125 | 1.696 | 3.3192 | 0.135 | 0.0809 | 0.0863 |
| 74 | Q38G_Q295A | 0.3453 | 8.3585 | 11.1794 | 0.8498 | 0.3854 | 1.5188 |
| 75 | D166E_Q295A | 0.3403 | 5.9791 | 1.1668 | 0.5835 | 0.4446 | 0.1339 |
| 76 | L219F_V294N | 0.3331 | 9.5132 | 23.3479 | 1.7313 | 0.5213 | 1.7665 |
| 77 | L219F_Q295A | 0.3374 | 8.5459 | 0.9632 | 0.7676 | 0.4075 | 0.1568 |
| 78 | L219F_Q295A | 0.3491 | 10.339 | 0.9624 | 0.9641 | 0.4572 | 0.1088 |
| 79 | V294N_Q295A | 0.3448 | 9.491 | 25.3286 | 1.8217 | 0.6272 | 2.3726 |
| 80 | A53Q_S177W | 0.267 | 16.0111 | 1.9004 | 0.581 | 0.274 | 0.8811 |
| 81 | A53Q_S177W | 0.2679 | 18.1078 | 2.2106 | 0.6227 | 0.248 | 0.5122 |
| 82 | A53Q_L219F | 0.2547 | 7.0862 | 15.0794 | 0.6211 | 0.2459 | 0.8256 |
| 83 | WT | 0.2166 | 5.7052 | 10.3837 | 0.6679 | 0.326 | 0.4558 |
| 84 | WT | 0.1964 | 4.9344 | 8.3046 | 0.5323 | 0.2672 | 0.5161 |
| 85 | A108G_Q161S | 0.2656 | 4.0905 | 2.095 | 0.498 | 0.2241 | 0.554 |
| 86 | A108G_G205M | 0.1069 | 0.7184 | 1.7257 | 0.1012 | 0.0519 | 0.1179 |
| 87 | Q161S_G205M | 0.2449 | 10.3718 | 10.2265 | 1.315 | 0.3328 | 1.2632 |
| 88 | F123H_L174V | 0.1403 | 0.6711 | 1.7437 | 0.0771 | 0.0465 | 0.1729 |
| 89 | F123H_S177E | 0.3403 | 1.9731 | 0.5717 | 0.15 | 0.0774 | 0.153 |

TABLE 4-continued

HPLC Area in mAU*min of prenylation products produced by Orf2 and Orf2 Variants when using OA as substrate and GPP as donor

| ID# | Mutations | 6.14 | CBGA | 5-GOA | 8.17 | 8.77 | 11.6 |
|---|---|---|---|---|---|---|---|
| 90 | L174V_S177E | 0.3898 | 16.4952 | 2.7406 | 0.7724 | 0.2891 | 1.2376 |
| 91 | A53T_D166E | 0.242 | 3.1403 | 18.5969 | 0.4713 | 0.3019 | 1.3883 |
| 92 | A53T_Q295W | 1.6781 | 22.1195 | 6.0823 | 1.6555 | 0.4152 | 3.7797 |
| 93 | D166E_Q295W | 0.7739 | 13.0528 | 2.9087 | 1.6617 | 0.2638 | 1.1289 |
| 94 | A53Q_S177Y | 0.1722 | 1.6822 | 6.6658 | 0.1745 | 0.1247 | 0.3941 |
| 95 | A53Q_Y288H | 2.0851 | 13.2602 | 2.0825 | 1.4116 | 1.8522 | 0.2549 |
| 96 | S177Y_Y288H | 0.7662 | 4.8269 | 0.8808 | 0.7668 | 0.6572 | 0.0963 |
| 97 | V49A_Q161S | 0.5978 | 6.6391 | 3.2987 | 0.7232 | 0.7494 | 0.2188 |
| 98 | V49A_V294A | 0.741 | 2.9734 | 4.071 | 0.3087 | 0.8879 | 0.1941 |
| 99 | Q161S_V294A | 0.2907 | 18.5112 | 19.4499 | 2.4585 | 0.549 | 3.238 |
| 100 | A53T_M106E | 0.4607 | 8.5722 | 13.3998 | 0.6753 | 0.2034 | 1.1296 |
| 101 | A53T_K118N | 0.1698 | 1.0746 | 6.1515 | 0.1137 | 0.0954 | 0.311 |
| 102 | A53T_S214F | 0.1244 | 14.0659 | 19.3815 | 0.5432 | 0.0211 | 0.3179 |
| 103 | A53T_S214F | 0.0534 | 5.7351 | 7.2164 | 0.3014 | 0.0485 | 0.1489 |
| 104 | K118N_S214F | 0.0788 | 0.5533 | 0.5112 | 0.0412 | 0.0184 | 0.0479 |
| 105 | WT | 0.4287 | 10.433 | 16.3978 | 1.2802 | 0.4668 | 1.1985 |
| 106 | Q295W | 0.683 | 17.6777 | 1.7024 | 1.9224 | 1.0897 | 0.8575 |
| 107 | Q295C | 0.6718 | 21.8175 | 1.785 | 1.8402 | 2.0448 | 1.7573 |
| 108 | Q295E | 0.2404 | 7.3647 | 0.5962 | 0.2611 | 0.1293 | 0.111 |
| 109 | Q295F | 0.9554 | 62.6583 | 0.6746 | 2.5003 | 1.2552 | 0.9292 |
| 110 | Q295G | 0.6592 | 19.6614 | 3.352 | 2.3502 | 0.8261 | 1.7693 |
| 111 | Q295H | 0.6702 | 16.0317 | 34.4247 | 2.4852 | 0.3933 | 1.5102 |
| 112 | Q295I | 0.7531 | 24.5172 | 0.6814 | 0.6973 | 1.2208 | 0.2052 |
| 113 | Q295L | 1.017 | 42.3189 | 0.8181 | 1.9052 | 3.3264 | 0.6838 |
| 114 | Q295M | 1.0329 | 50.0921 | 1.7649 | 2.497 | 1.7455 | 1.4423 |
| 115 | Q295N | 0.3461 | 5.4797 | 4.0139 | 0.6466 | 0.6109 | 0.1501 |
| 116 | WT | 0.2794 | 7.7755 | 13.2073 | 0.9478 | 0.3935 | 0.7294 |
| 117 | A108G | 0.1028 | 1.0247 | 1.9316 | 0.1598 | 0.0929 | 0.0583 |
| 118 | A53Q | 0.2373 | 6.8076 | 17.9665 | 0.8513 | 0.2734 | 1.2782 |
| 119 | A53T | 0.4698 | 9.639 | 33.3605 | 1.6065 | 0.7544 | 4.0906 |
| 120 | D166E | 0.1719 | 3.5491 | 7.1374 | 0.371 | 0.2443 | 0.4411 |
| 121 | F123H | 0.095 | 1.0763 | 3.4321 | 0.1215 | 0.0978 | 0.1436 |
| 122 | G205M | 0.2882 | 7.6703 | 16.3875 | 1.0934 | 0.4238 | 1.2809 |
| 123 | K118N | 0.1028 | 1.0956 | 1.879 | 0.0971 | 0.0929 | 0.0493 |
| 124 | L219F | 0.1908 | 5.9595 | 8.0826 | 0.6165 | 0.2318 | 0.3464 |
| 125 | L219F | 0.246 | 7.3438 | 9.5117 | 0.6977 | 0.2841 | 0.3849 |
| 126 | M106E | 0.1691 | 4.3079 | 3.2674 | 0.2687 | 0.0997 | 0.1292 |
| 127 | WT | 0.2721 | 7.8954 | 12.4886 | 0.751 | 0.3353 | 0.4043 |
| 128 | Q161S | 0.3172 | 22.413 | 17.1289 | 2.607 | 0.6246 | 3.1877 |
| 129 | Q295A | 0.4619 | 13.257 | 1.5994 | 0.9306 | 0.6536 | 0.5911 |
| 130 | Q295W | 1.8373 | 43.6399 | 5.4222 | 2.3826 | 0.5376 | 0.9611 |
| 131 | Q38G | 0.2139 | 4.1646 | 6.3441 | 0.4349 | 0.1855 | 0.3908 |
| 132 | S177E | 0.5335 | 24.3551 | 3.2656 | 1.5548 | 0.4375 | 1.645 |
| 133 | S177W | 0.2431 | 13.5221 | 1.0317 | 0.4704 | 0.3223 | 0.4572 |
| 134 | S177Y | 0.1585 | 2.0079 | 4.2248 | 0.181 | 0.1149 | 0.1737 |
| 135 | S214F | 0.0648 | 4.2346 | 3.1597 | 0.161 | 0.0091 | 0.0686 |
| 136 | V294A | 0.3317 | 9.1221 | 24.672 | 1.4785 | 0.5044 | 2.0348 |
| 137 | V294N | 0.297 | 7.5944 | 19.5151 | 1.3176 | 0.4402 | 0.8056 |
| 138 | V49A | 0.563 | 2.9941 | 2.673 | 0.248 | 0.8594 | 0.1493 |
| 139 | Y288H | 1.0891 | 8.1857 | 0.9592 | 1.2335 | 0.9156 | 0.0611 |
| 140 | Q161D | 0.1486 | 5.9897 | 0.9657 | 0.5883 | 0.1173 | 0.0344 |
| 141 | Q161P | 0.1031 | 1.5397 | 22.6152 | 0.3745 | 0.2025 | 0.6503 |
| 142 | Q161W | 0.1348 | 1.4308 | 2.4821 | 0.2116 | 0.1461 | 0.0576 |
| 143 | A53I | 0.8859 | 12.3261 | 26.2444 | 0.7359 | 1.4753 | 0.4959 |
| 144 | A53R | 0.2385 | 3.2831 | 8.8328 | 0.2998 | 0.3083 | 0.2622 |
| 145 | A53T | 0.4372 | 9.0726 | 30.1103 | 1.2665 | 0.5775 | 2.3975 |
| 146 | A53W | 0.1326 | 1.9501 | 7.8002 | 0.2677 | 0.135 | 0.2937 |
| 147 | V64_M106E_M162A_Y216A | 0.0707 | 0.2105 | 0.3622 | 0.0191 | 0.014 | 0.0326 |
| 148 | WT | 0.3951 | 6.4459 | 10.029 | 0.5996 | 0.2187 | 0.5594 |
| 149 | K118Q | 0.2773 | 2.9905 | 10.2832 | 0.1687 | 0.1305 | 0.3055 |
| 150 | K119Q | 0.1461 | 0.2304 | 0.874 | 0.0355 | 0.0174 | 0.0167 |
| 151 | M162A | 0.1766 | 0.476 | 16.0271 | 0.0655 | 0.0107 | 0.4676 |
| 152 | Q161A | 0.2113 | 4.4385 | 36.2776 | 1.2967 | 0.3311 | 2.6936 |
| 153 | K119D | 0.4193 | 7.7581 | 10.6118 | 0.8274 | 0.4077 | 2.0115 |
| 154 | G205L | 0.2478 | 2.1074 | 6.6107 | 0.3247 | 0.0956 | 0.1912 |
| 155 | F123A | 0.268 | 1.9874 | 5.053 | 0.2065 | 0.1143 | 0.4062 |
| 156 | K118N | 0.2261 | 1.7015 | 2.9776 | 0.1282 | 0.0962 | 0.0571 |
| 157 | Q161W | 0.2608 | 1.9803 | 3.5027 | 0.362 | 0.1793 | 0.0972 |
| 158 | D227E | 0.3836 | 5.9881 | 11.523 | 0.6316 | 0.2788 | 0.6984 |
| 159 | WT | 0.5656 | 10.3883 | 16.1129 | 1.304 | 0.5864 | 1.8709 |
| 160 | WT | 0.4649 | 8.0525 | 11.5233 | 1.0342 | 0.4325 | 1.7098 |
| 161 | Q295W | 1.9421 | 40.163 | 4.5826 | 3.0238 | 0.7556 | 6.6166 |
| 162 | Q295P | 0.4679 | 4.9878 | 1.6758 | 0.5541 | 0.792 | 0.3127 |
| 163 | Q295R | 0.3226 | 0.3891 | 6.9755 | 0.0748 | 0.0444 | 0.1745 |
| 164 | Q295S | 0.4731 | 6.0574 | 2.4658 | 0.8139 | 0.5717 | 0.2357 |

TABLE 4-continued

| HPLC Area in mAU*min of prenylation products produced by Orf2 and Orf2 Variants when using OA as substrate and GPP as donor | | | | | | | |
|---|---|---|---|---|---|---|---|
| ID# | Mutations | 6.14 | CBGA | 5-GOA | 8.17 | 8.77 | 11.6 |
| 165 | Q295T | 0.4314 | 2.2987 | 0.5716 | 0.1575 | 0.2201 | 0.0178 |
| 166 | Q295V | 1.2494 | 19.6029 | 0.5385 | 0.6364 | 3.0718 | 0.2259 |
| 167 | A53T_V294A | 0.4167 | 5.8761 | 36.6497 | 1.3877 | 0.4617 | 3.3157 |
| 168 | A53T_Q161S_V294A | 0.5039 | 15.381 | 33.5956 | 2.8747 | 0.5372 | 5.0464 |
| 169 | A53T_Q161S_V294N | 0.3568 | 11.9604 | 27.5382 | 2.4274 | 0.4483 | 3.6533 |
| 170 | A53T_Q295A | 1.4841 | 26.0366 | 3.7553 | 2.131 | 2.1193 | 6.2522 |
| 171 | Q161S_V294A_Q295A | 0.8397 | 46.9066 | 9.5266 | 3.9359 | 1.4569 | 6.8713 |
| 172 | A53T_Q161S_Q295A | 0.9326 | 34.1016 | 14.121 | 3.9918 | 1.3472 | 7.7645 |
| 173 | A53T_V294A_Q295A | 1.9935 | 37.8163 | 4.0888 | 2.503 | 2.968 | 10.274 |
| 174 | A53T_Q161S_V294A_Q295A | 1.0662 | 36.8247 | 18.7595 | 4.0408 | 1.4274 | 10.6352 |
| 175 | A53T_Q161S_V294N_Q295A | 0.8243 | 28.9549 | 15.8073 | 3.9841 | 1.2173 | 9.6389 |
| 176 | A53T_Q295W | 2.8333 | 41.0901 | 9.6799 | 3.1369 | 0.8036 | 10.3205 |
| 177 | Q161S_V294A_Q295W | 2.5294 | 68.3285 | 2.8122 | 3.5179 | 1.0696 | 4.4695 |
| 178 | A53T_Q161S_Q295W | 3.1489 | 68.7659 | 4.4902 | 3.7534 | 1.0874 | 7.7376 |
| 179 | A53T_V294A_Q295W | 2.3271 | 38.5309 | 12.362 | 3.4467 | 0.7316 | 9.2623 |
| 180 | A53T_Q161S_V294A_Q295W | 2.7241 | 63.9702 | 4.908 | 3.5416 | 0.8621 | 6.4643 |
| 181 | A53T_Q161S_V294N_Q295W | 2.4544 | 58.018 | 7.059 | 3.6741 | 0.9941 | 7.4983 |
| 182 | WT | 0.3273 | 7.5303 | 13.0854 | 0.9789 | 0.429 | 1.3818 |
| 183 | L274V | 0.18 | 1.6769 | 4.0405 | 0.3029 | 0.0859 | 0.1306 |
| 184 | S214G | 0.5101 | 0.9282 | 30.7747 | 0.222 | 0.4255 | 0.8022 |
| 185 | Y216A | 0.1704 | 0.4385 | 0.554 | 0.1316 | 0.0326 | 0.0097 |
| 186 | F123W | 0.0596 | 0.0333 | 0.0779 | 0.006 | 0.003 | 0.0051 |
| 187 | V271E | 0.0803 | 0.0522 | 0.0307 | 0.0087 | 0.0006 | 0.0057 |
| 188 | N173D | 0.1069 | 0.7167 | 1.8555 | 0.1497 | 0.0369 | 0.0522 |
| 189 | R228Q | 0.0909 | 0.8429 | 1.7305 | 0.074 | 0.036 | 0.0219 |
| 190 | M162F | 0.2485 | 4.4581 | 0.6972 | 0.5871 | 0.0533 | 0.0933 |
| 191 | A232S | 0.6408 | 36.2083 | 2.6149 | 5.1383 | 1.7018 | 1.9619 |
| 192 | C230S | 0.2263 | 3.5449 | 5.7749 | 0.6643 | 0.1284 | 0.4746 |
| 193 | V294F | 0.2697 | 3.8771 | 10.1682 | 0.6331 | 0.2769 | 1.1748 |
| 194 | Y283L | 0.2493 | 5.3759 | 12.915 | 0.7704 | 0.2779 | 0.5191 |
| 195 | S214R | 1.2478 | 50.9997 | 0.0411 | 4.4719 | 0.0638 | 0.0995 |
| 196 | G286E | 0.0983 | 0.206 | 0.1239 | 0.1018 | 0.0026 | 0.01 |
| 197 | V63_F123W_M162F_C209G | 0.0443 | 0.012 | 0.0502 | 0.002 | 0.0014 | 0.0134 |
| 198 | WT | 0.1295 | 3.9794 | 7.4058 | 0.5023 | 0.2259 | 0.2396 |
| 199 | S177W_L219F | 0.1351 | 5.9191 | 0.618 | 0.1856 | 0.0846 | 0.0683 |
| 200 | S214C | 0.0291 | 0.3974 | 1.582 | 0.1749 | 0.0029 | 0.0154 |
| 201 | S214D | 0.0839 | 1.7316 | 1.2328 | 0.3774 | 0.0072 | 0.0518 |
| 202 | S214E | 0.1331 | 3.514 | 0.1887 | 0.1044 | 0.0117 | 0.002 |
| 203 | S214F | 0.0212 | 1.8923 | 1.6135 | 0.0784 | 0.0012 | 0.0024 |
| 204 | S214H | 0.3828 | 42.8471 | 0.035 | 3.0202 | 0.0109 | 0.0176 |
| 205 | S214I | 0.0255 | 2.1462 | 0.6227 | 0.3675 | 0.001 | 0.0035 |
| 206 | S214L | 0.0207 | 0.3664 | 0.147 | 0.0065 | 0.0039 | 0.0006 |
| 207 | S214M | 0.025 | 1.2355 | 0.2679 | 0.0664 | 0.0013 | 0.0022 |
| 208 | S214N | 0.5202 | 2.582 | 1.2494 | 0.1251 | 0.0113 | 0.0002 |
| 209 | S214R | 0.5724 | 18.2997 | 0.0387 | 2.6847 | 0.0327 | 0.0064 |
| 210 | S214K | 0.1002 | 1.3288 | 0.2202 | 0.4215 | 0.0024 | 0.0076 |
| 211 | Q161A | 0.1296 | 3.5758 | 19.5936 | 0.727 | 0.1917 | 1.4337 |
| 212 | Q161H | 0.6716 | 81.4919 | 0.1983 | 3.5414 | 0.1028 | 0.7037 |
| 213 | Q161K | 0.1422 | 6.6077 | 2.1052 | 0.8148 | 0.0439 | 0.1206 |
| 214 | A53F | 0.0774 | 0.557 | 0.1938 | 0.0262 | 0.0074 | 0.0029 |
| 215 | A53H | 0.0706 | 0.3996 | 0.4786 | 0.0307 | 0.0123 | 0.0055 |
| 216 | S177W_Q295A | 0.2927 | 56.035 | 0.1016 | 2.1226 | 0.2866 | 0.1206 |
| 217 | S177W_S214R | 0.2153 | 14.1529 | 0.0913 | 2.2588 | 0.1406 | 0.0075 |
| 218 | Q161S_S177W | 0.1678 | 21.9926 | 0.6705 | 0.6861 | 0.2034 | 0.1344 |
| 219 | A53T_S177W | 0.5864 | 25.6741 | 1.8121 | 0.9362 | 0.5536 | 2.4301 |
| 220 | V49A_Q295L | 0.395 | 2.3805 | 0.277 | 0.1062 | 0.6176 | 0.001 |
| 221 | V49A_S214R | 0.2034 | 3.4446 | 0.0741 | 1.7704 | 0.0072 | 0.0053 |
| 222 | A53T_Q295F | 1.1064 | 52.6928 | 1.1825 | 1.8096 | 0.9711 | 0.9881 |
| 223 | A53T_S214R | 1.1626 | 62.6579 | 0.1069 | 2.9573 | 0.068 | 0.0177 |
| 224 | A53T_A161S | 0.3052 | 16.0001 | 24.5577 | 2.6147 | 0.535 | 6.7362 |
| 225 | Q161S_Q295F | 0.6414 | 55.4403 | 0.6309 | 2.1875 | 0.7435 | 0.0564 |
| 226 | Q161S_Q295L | 0.7049 | 57.0803 | 0.4619 | 2.0677 | 0.6818 | 0.2445 |
| 227 | Q16S_S214R | 0.6373 | 24.2694 | 0.1169 | 1.989 | 0.0414 | 0.0071 |
| 228 | S214R_Q295F | 0.8804 | 34.6447 | 0.1255 | 2.5773 | 0.0884 | 0.001 |
| 229 | WT | 0.2208 | 5.5566 | 8.7128 | 0.4774 | 0.2105 | 0.0567 |
| 230 | WT | 0.2019 | 6.6574 | 11.2225 | 0.8057 | 0.3334 | 0.4059 |
| 231 | L274V | 0.0826 | 1.6646 | 3.9537 | 0.2627 | 0.0688 | 0.0329 |
| 232 | S214T | 0.2083 | 6.712 | 10.2212 | 0.9388 | 0.2872 | 0.2863 |
| 233 | S214V | 0.1755 | 5.0328 | 8.8147 | 0.6174 | 0.2149 | 0.0792 |
| 234 | S214W | 0.0449 | 0.1535 | 0.6665 | 0.0326 | 0.0087 | 0.0005 |
| 235 | S214Y | 0.0496 | 0.5011 | 0.4133 | 0.0955 | 0.0054 | 0.0088 |
| 236 | Q161G | 0.1208 | 3.8872 | 7.4013 | 0.5613 | 0.3219 | 0.0963 |
| 237 | Q161N | 0.221 | 5.6957 | 7.523 | 1.2476 | 0.4097 | 0.2463 |
| 238 | Q161Q | 0.2016 | 5.4929 | 8.742 | 0.6879 | 0.234 | 0.1869 |
| 239 | A53M | 0.311 | 9.7583 | 19.2442 | 1.1438 | 0.4805 | 2.0646 |

TABLE 4-continued

HPLC Area in mAU*min of prenylation products produced by Orf2 and Orf2 Variants when using OA as substrate and GPP as donor

| ID# | Mutations | 6.14 | CBGA | 5-GOA | 8.17 | 8.77 | 11.6 |
|---|---|---|---|---|---|---|---|
| 240 | A53N | 0.2218 | 2.4624 | 10.3493 | 0.3211 | 0.3024 | 0.0897 |
| 241 | A53S | 0.3224 | 8.1922 | 18.0214 | 1.0041 | 0.4861 | 0.6177 |
| 242 | A53V | 0.7299 | 14.7985 | 22.9622 | 1.3494 | 1.3611 | 1.3562 |
| 243 | V24_A17T_F213M_S214R | 0.3521 | 16.6698 | 1.1314 | 4.1319 | 0.0629 | 0.1537 |
| 244 | Q295D | 0.5733 | 18.3969 | 11.5976 | 2.4133 | 1.5527 | 0.6172 |
| 245 | Q295K | 0.0819 | 1.6736 | 2.1622 | 0.2654 | 0.1629 | 0.0108 |
| 246 | Q295Y | 0.2237 | 7.6066 | 12.2165 | 0.8911 | 0.3371 | 0.1724 |
| 247 | A53G | 0.1547 | 2.7595 | 5.9764 | 0.24 | 0.1403 | 0.0229 |
| 248 | R228E | 0.0515 | 0.2099 | 0.1217 | 0.0622 | 0.0373 | 0.0004 |
| 249 | V36_F123H_L274V_L298A | 0.051 | 0.1485 | 0.8637 | 0.0289 | 0.0137 | 0.0018 |
| 250 | A53T_Q161S | 0.3657 | 19.2281 | 31.4494 | 3.5463 | 0.8091 | 7.6038 |
| 251 | M106E_Q161S | 0.1744 | 7.49 | 2.589 | 0.6149 | 0.1254 | 0.0924 |
| 252 | Q161H | 0.9829 | 109.9146 | 0.227 | 5.9319 | 0.1264 | 1.1306 |
| 253 | WT | 0.1954 | 4.6359 | 7.4486 | 0.3732 | 0.1468 | 0.0272 |
| 254 | Q161F | 0.128 | 27.5673 | 7.257 | 1.5873 | 0.1279 | 0.04 |
| 255 | Q161C | 0.158 | 4.7623 | 17.4493 | 0.8952 | 0.6105 | 0.0815 |
| 256 | Q161I | 0.2042 | 9.7125 | 13.328 | 1.9642 | 0.4285 | 0.1821 |
| 257 | Q161L | 0.2876 | 18.4053 | 14.7978 | 2.3238 | 0.598 | 0.1327 |
| 258 | Q161L | 0.2246 | 10.9114 | 7.7533 | 1.1244 | 0.2879 | 0.1269 |
| 259 | Q161M | 0.382 | 7.7445 | 4.7748 | 1.1765 | 0.1278 | 0.0187 |
| 260 | Q161R | 0.2666 | 46.6768 | 1.2868 | 2.4397 | 0.1476 | 0.3194 |
| 261 | Q161S | 0.2517 | 16.4399 | 12.1391 | 1.6485 | 0.3805 | 0.3996 |
| 262 | Q161T | 0.1981 | 13.056 | 13.825 | 1.2124 | 0.39 | 0.23 |
| 263 | Q161Y | 0.4703 | 63.2878 | 1.2931 | 3.2096 | 0.0907 | 0.4055 |
| 264 | A53D | 0.0871 | 2.9572 | 4.5759 | 0.5434 | 0.0472 | 0.0281 |
| 265 | A53E | 0.0379 | 0.1118 | 0.2432 | 0.0218 | 0.0042 | 0.0004 |
| 266 | A53K | 0.3449 | 7.4579 | 20.1422 | 0.8075 | 0.6095 | 0.179 |
| 267 | A53L | 0.3036 | 13.0793 | 22.6841 | 1.2092 | 0.4786 | 0.2762 |
| 268 | A53Q | 0.2069 | 6.3683 | 16.0499 | 0.6179 | 0.2693 | 0.2291 |
| 269 | A53Y | 0.0732 | 0.7478 | 1.257 | 0.0585 | 0.0426 | 0.0032 |
| 270 | Q295A | 1.45 | 30.5523 | 5.1674 | 3.4945 | 0.5593 | 2.9359 |
| 271 | Q295W | 0.683 | 17.6777 | 1.7024 | 1.9224 | 1.0897 | 0.8575 |
| 272 | WT | 0.4649 | 8.0525 | 11.5233 | 1.0342 | 0.4325 | 1.7098 |
| 273 | L174V | 0.339 | 7.2679 | 9.5109 | 0.6455 | 0.2795 | 0.1771 |
| 274 | S214G | 0.4628 | 0.9812 | 34.2622 | 0.211 | 0.3627 | 0.0795 |
| 275 | S214P | 0.0645 | 0.0151 | 0.1079 | 0.0008 | 0.0023 | 0.0053 |
| 276 | S214Q | 0.3381 | 37.0271 | 0.2656 | 0.1828 | 0.0046 | 0.0036 |
| 277 | Q161E | 0.1599 | 2.703 | 1.7568 | 0.4425 | 0.1704 | 0.0228 |
| 278 | Q161V | 0.129 | 4.6063 | 10.6973 | 1.195 | 0.4385 | 0.1816 |
| 279 | A53C | 0.334 | 9.5731 | 16.0387 | 1.0506 | 0.5481 | 0.4817 |
| 280 | A53P | 0.0747 | 0.0451 | 0.39 | 0.0083 | 0.0036 | 0.0052 |
| 281 | Y288A | 1.2332 | 70.5504 | 0.122 | 5.152 | 1.3043 | 0.4672 |
| 282 | Y288C | 0.8582 | 59.513 | 0.1853 | 5.4251 | 1.0554 | 0.154 |
| 283 | Y288D | 0.0662 | 3.2022 | 0.0347 | 1.7484 | 0.0233 | 0.0039 |
| 284 | Y288E | 0.0559 | 2.6166 | 0.0307 | 1.4904 | 0.0141 | 0.0049 |
| 285 | Y288F | 1.0143 | 67.0312 | 0.0858 | 4.7424 | 0.0819 | 0.0079 |
| 286 | Y288G | 0.1738 | 11.8688 | 0.0676 | 2.6629 | 0.0994 | 0.0016 |
| 287 | Y288H | 1.0257 | 6.1445 | 0.7417 | 0.9226 | 0.4448 | 0.0117 |
| 288 | Y288I | 0.9064 | 71.5931 | 0.3191 | 4.4341 | 0.4007 | 0.0446 |
| 289 | Y288K | 0.0245 | 0.6425 | 0.029 | 0.3762 | 0.002 | 0.0003 |
| 290 | Y288L | 0.7057 | 84.6669 | 0.2346 | 4.7892 | 0.5323 | 0.1376 |
| 291 | Y288M | 0.9983 | 54.3471 | 0.2693 | 4.862 | 0.3085 | 0.0364 |
| 292 | Y288P | 0.7331 | 77.4833 | 0.104 | 5.5638 | 0.5515 | 0.1371 |
| 293 | Y288R | 0.0229 | 1.1367 | 0.0766 | 0.7247 | 0.0043 | 0.0032 |
| 294 | Y288S | 0.3611 | 12.8468 | 0.0977 | 3.6178 | 0.2047 | 0.0046 |
| 295 | Y288T | 0.6419 | 54.0312 | 0.3235 | 4.2209 | 0.8107 | 0.0219 |
| 296 | Y288W | 0.3844 | 16.3538 | 0.1631 | 1.9368 | 0.0849 | 0.0016 |
| 297 | A232S | 0.4929 | 33.1432 | 2.3783 | 4.1203 | 1.2447 | 0.3794 |
| 298 | N173D | 0.0836 | 1.9762 | 0.0376 | 1.0538 | 0.005 | 0.0006 |
| 299 | N173D | 0.0236 | 0.2661 | 0.6775 | 0.0489 | 0.0074 | 0.0029 |
| 300 | M162F | 0.1961 | 3.5943 | 0.6082 | 0.4251 | 0.0244 | 0.0037 |
| 301 | WT | 0.2123 | 7.0619 | 10.2794 | 0.8529 | 0.3416 | 0.7319 |
| 302 | A17T | 0.1242 | 4.0412 | 7.8405 | 0.628 | 0.5977 | 0.1111 |
| 303 | A232S | 0.0591 | 1.9577 | 8.8043 | 0.5397 | 0.0842 | 0.0704 |
| 304 | M162F | 0.2146 | 3.7911 | 0.256 | 0.6318 | 0.0476 | 0.0124 |
| 305 | WT | 0.282 | 9.093 | 15.161 | 1.181 | 0.452 | 0.88 |
| 306 | A232S | 0.431 | 32.214 | 2.462 | 4.182 | 3.258 | 0.477 |
| 307 | A232S | 0.393 | 30.338 | 2.061 | 3.897 | 3.301 | 0.713 |
| 308 | S214A | 0.305 | 0.96 | 15.595 | 0.525 | 0.216 | 0.317 |
| 309 | S214A | 0.36 | 1.376 | 18.837 | 0.706 | 0.272 | 0.143 |
| 310 | S214Q | 0.375 | 36.474 | 0.344 | 0.248 | 0.006 | 0.039 |
| 311 | S214Q | 0.33 | 30.356 | 0.229 | 0.176 | 0.016 | 0.024 |
| 312 | Q161E | 0.246 | 3.219 | 2.183 | 0.636 | 0.3 | 0.117 |
| 313 | Y288N | 0.217 | 4.42 | 0.16 | 1.786 | 0.078 | 0.003 |

Figure 2:
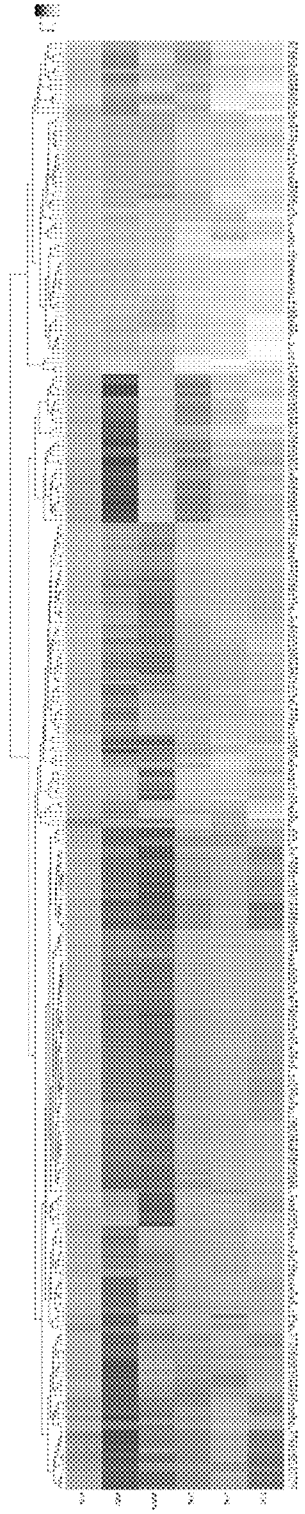
FIG. 2 shows a heatmap of prenylated products produced from Orf2 mutants when using OA as substrate and GPP as donor.

The amount of each prenylation product was measured by HPLC. FIG. 2 shows a heatmap of the HPLC areas of each prenylation product generated using OA as substrate and GPP as donor. Each column represents a single prenylation product and each row represents an Orf2 or Orf2 variant. Prenylation products are labeled by retention time with the exception of CBGA and 5-GOA which are labeled by molecule name. Enzyme variants are labeled by ID #as listed in Table 4.

Example 4: Generation of ORF2 Variants which Synthesize an Altered Amount of Prenylated Products when Using OA as Substrate and FPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position.

The wild type Orf2 prenylation reaction using OA as substrate and FPP as donor produces 4 products as detected by HPLC. The respective retention times of these products are approximately 8.4 [CBFA], 8.8 [5-FOA], 9.9, and 11.1 minutes.

Table 5 provides a summary of the prenylation products produced from OA and FPP, their retention times, and the hypothesized prenylation site on OA. FIG. 18 shows the predicted chemical structures of the respective prenylation products.

TABLE 5

Predicted prenylation products of Orf2 or Orf2 Mutants when using OA as substrate and FPP as donor

| Molecule ID | Substrate | Donor | Attachment Site | Retention Time |
|---|---|---|---|---|
| RBI-56 | OA | FPP | 2-O | 11.127 |
| UNK5 | OA | FPP | 4-O | 9.912 |
| RBI-14 (CBFA) | OA | FPP | 3-C | 8.362 |
| RBI-16 (5-FOA) | OA | FPP | 5-C | 8.805 |

Table 6 provides a summary of the analysis performed on the enzymatic activity of the ORF2 variants to produce prenylated products using OA as substrate and FPP as donor. Table 6 lists the mutations within each of the mutants analyzed as well mAU*min areas from the HPLC analysis of the reaction products.

TABLE 6

HPLC Area in mAU*min of prenylation products produced by Orf2 and Orf2 Variants when using OA as substrate and FPP as donor

| ID # | Mutations | CBFA (8.362) | 5-FOA (8.805) | 9.912 | 11.127 |
|---|---|---|---|---|---|
| 0 | WT | 0.1254 | 0.3451 | 0.0109 | 0.0086 |
| 1 | V9_Q38G_E112D_F123H | 0.0981 | 1.2392 | 0.0095 | 0.0064 |
| 2 | V17_V49L_F123A_Y283L | 0.0211 | 0.0112 | 0.0014 | 0.001 |
| 3 | V25_L219F_V294N_Q295A | 0.4785 | 0.0627 | 0.0942 | 0.0289 |
| 4 | V33_A17T_C25V_E112G | 0.0685 | 0.1632 | 0.0101 | 0.0225 |
| 5 | V49_G205L_R228E_C230N | 0.0203 | 0.0046 | 0.001 | 0.0003 |
| 6 | V57_C25V_A232S_V271E | 0.0203 | 0.0046 | 0.0009 | 0.0001 |
| 7 | V65_V49A_Q161S_V294A | 0.1861 | 0.0386 | 0.0164 | 0.0253 |
| 8 | V73_V49S_K118Q_S177E | 0.0188 | 0.0373 | 0.0011 | 0.0016 |
| 9 | V81_V49L_D166E_L274V | 0.0115 | 0.0013 | 0.0006 | 0.0002 |
| 10 | V89_Y121W_S177Y_G286E | 0.012 | 0.0008 | 0.001 | 0.0005 |
| 11 | V10_V49A_S177Y_C209G | 0.0135 | 0.005 | 0.0004 | 0.0002 |
| 12 | V26_A53E_A108G_K118N | 0.0159 | 0.0038 | 0.0012 | 0.0008 |
| 13 | V34_A53Q_Y121W_A232S | 0.01 | 0.0021 | 0.001 | 0.0009 |
| 14 | V42_D166E_S177Y_S214F | 0.0123 | 0.0029 | 0.0005 | 0.0003 |
| 15 | V58_K118Q_L174V_R228Q | 0.0188 | 0.0034 | 0.0002 | 0.0005 |
| 16 | V66_C25V_F213M_Y216A | 0.0056 | 0.0015 | 0.0001 | 0.0008 |
| 17 | V74_M106E_Y121W_D166E | 0.0176 | 0.0034 | 0.0019 | 0.0003 |
| 18 | V82_V49S_K119D_F213M | 0.0097 | 0.0016 | 0.0006 | 0.0003 |
| 19 | V90_A17T_F123W_L298A | 0.0425 | 0.0707 | 0.0096 | 0.0042 |
| 20 | V3_V49S_M162A_Y283L | 0.0114 | 0.1739 | 0.0003 | 0.0024 |
| 21 | V11_K118N_K119A_V271E | 0.0089 | 0.0008 | 0.0005 | 0.0014 |
| 22 | V19_V49L_S214R_V271E | 0.0105 | 0.002 | 0.0008 | 0.0005 |
| 23 | V35_A53Q_S177Y_Y288H | 0.2502 | 0.0845 | 0.0394 | 0.0183 |
| 24 | V43_Q161A_M162F_Q295A | 0.2689 | 0.0092 | 0.021 | 0.003 |
| 25 | V51_V49L_K119D_G205M | 0.0093 | 0.0018 | 0.0030 | 0.0009 |
| 26 | V59_V49S_S214G_V294A | 0.0174 | 0.0507 | 0.0008 | 0.0033 |
| 27 | V67_A108G_K119D_L298A | 0.0059 | 0.0014 | 0.0008 | 0.0004 |
| 28 | V75_A53Q_L274V_Q295A | 0.0132 | 0.0047 | 0.0006 | 0.001 |
| 29 | V83_E112D_L219F_V294F | 0.1103 | 1.0019 | 0.0147 | 0.0045 |
| 30 | V91_N173D_F213M_V294F | 0.0055 | 0.01 | 0.0007 | 0.0004 |
| 31 | V4_K118Q_Q161W_S214F | 0.0081 | 0.0014 | 0.0022 | 0.0004 |
| 32 | V20_D227E_C230N_Q295W | 0.0115 | 0.007 | 0.0007 | 0.0002 |
| 33 | V28_A53T_D166E_Q295W | 0.101 | 0.1975 | 0.0129 | 0.0021 |

TABLE 6-continued

HPLC Area in mAU*min of prenylation products produced by Orf2 and Orf2 Variants when using OA as substrate and FPP as donor

| ID # | Mutations | CBFA (8.362) | 5-FOA (8.805) | 9.912 | 11.127 |
|---|---|---|---|---|---|
| 34 | V44_A53E_Q161A_V294N | 0.0159 | 0.0285 | 0.0015 | 0.0009 |
| 35 | WT | 0.3691 | 0.815 | 0.0637 | 0.0307 |
| 36 | WT | 0.3563 | 0.746 | 0.0509 | 0.0303 |
| 37 | V52_K119A_S214G_L298A | 0.0227 | 0.0155 | 0.0021 | 0.0008 |
| 38 | V60_E112D_K119A_N173D | 0.036 | 0.0026 | 0.0003 | 0.0012 |
| 39 | V68_K118N_C209G_R228Q | 0.0296 | 0.0031 | 0.0002 | 0.0004 |
| 40 | V76_V49A_F123A_Y288H | 0.0225 | 0.0012 | 0.0014 | 0.0011 |
| 41 | V84_F123H_L174V_S177E | 0.1191 | 0.1545 | 0.0127 | 0.0057 |
| 42 | V92_A53T_E112D_G205M | 0.2532 | 2.6287 | 0.0476 | 0.0352 |
| 43 | V69_A53T_M106E_Q161S | 0.1155 | 0.1727 | 0.0134 | 0.0045 |
| 44 | V60_E112D_K119A_N173D | 0.0278 | 0.0034 | 0.002 | 0.0003 |
| 45 | V62_A53T_N173D_S214R | 0.0281 | 0.0004 | 0.0096 | 0.0014 |
| 46 | V70_Q38G_D166E_Q295A | 0.1879 | 0.2481 | 0.0211 | 0.0131 |
| 47 | V78_K119D_Q161W_L298Q | 0.0334 | 0.0077 | 0.0005 | 0.0002 |
| 48 | V94_A17T_V49A_C230N | 0.023 | 0.0018 | 0.001 | 0.0005 |
| 49 | V15_A53E_F213M_R228Q | 0.0235 | 0.0153 | 0.0001 | 0.0002 |
| 50 | V23_L219F_Y283L_L298W | 0.1093 | 1.4518 | 0.0013 | 0.0044 |
| 51 | V31_D227E_R228E_L298Q | 0.01 | 0.0044 | 0.0008 | 0.0012 |
| 52 | V39_A53T_K118N_S214F | 0.0369 | 0.0042 | 0.0008 | 0.0017 |
| 53 | V47_K118Q_F123A_R228E | 0.008 | 0.0025 | 0.0007 | 0.0005 |
| 54 | V55_V49S_Y216A_V294N | 0.021 | 0.004 | 0.0007 | 0.0005 |
| 55 | V71_M106E_G205L_C209G | 0.0572 | 0.0039 | 0.0014 | 0.0012 |
| 56 | V79_V49A_Y121W_C230S | 0.0212 | 0.003 | 0.0023 | 0.0006 |
| 57 | V87_S177W_Y288H_V294N | 0.0575 | 0.004 | 0.0083 | 0.0017 |
| 58 | V95_A17T_Q161W_A232S | 0.2039 | 0.0213 | 0.0124 | 0.0076 |
| 59 | V8_K119A_Q161A_R228Q | 0.0231 | 0.0012 | 0.0012 | 0.0011 |
| 60 | V16_A53Q_S177W_L219F | 0.2665 | 0.1223 | 0.035 | 0.0001 |
| 61 | V32_M162A_C209G_Y288H | 0.0407 | 0.0049 | 0.0017 | 0.0007 |
| 62 | V40_S177E_S214R_R228E | 0.0542 | 0.0002 | 0.0028 | 0.0021 |
| 63 | V48_V49L_E112D_G286E | 0.0326 | 0.0023 | 0.0003 | 0.0162 |
| 64 | V56_F123A_M162F_S214G | 0.0396 | 0.4291 | 0.002 | 0.0004 |
| 65 | V72_E112G_G205M_L298W | 0.2705 | 3.1689 | 0.0161 | 0.0122 |
| 66 | V80_M162A_N173D_S214F | 0.0213 | 0.0972 | 0.0016 | 0.0006 |
| 67 | V88_A108G_Q161S_G205M | 0.0208 | 0.0167 | 0.0003 | 0.003 |
| 68 | V64_M106E_M162A_Y216A | 0.0266 | 0.0067 | 0.001 | 0.0012 |
| 69 | V63_F123W_M162F_C209G | 0.0281 | 0.003 | 0.001 | 0.001 |
| 70 | V24_A17T_F213M_S214R | 0.6667 | 0.0121 | 0.166 | 0.001 |
| 71 | V36_F123H_L274V_L298A | 0.0126 | 0.0325 | 0.0008 | 0.0004 |
| 72 | WT | 0.182 | 0.337 | 0.0244 | 0.0158 |
| 73 | Q38G_D166E | 0.0299 | 0.0877 | 0.0024 | 0.0028 |
| 74 | Q38G_Q295A | 0.2205 | 0.546 | 0.0438 | 0.0287 |
| 75 | D166E_Q295A | 0.1585 | 0.0333 | 0.0338 | 0.0208 |
| 76 | L219F_V294N | 0.2322 | 0.2744 | 0.0459 | 0.0256 |
| 77 | L219F_Q295A | 0.2943 | 0.0308 | 0.056 | 0.0297 |
| 78 | V294N_Q295A | 0.5592 | 0.6994 | 0.1025 | 0.0584 |
| 79 | A53Q_S177W | 0.1762 | 0.059 | 0.0164 | 0.0009 |
| 80 | A53Q_L219F | 0.129 | 0.4877 | 0.022 | 0.0113 |
| 81 | S177W_L219F | 0.1792 | 0.0469 | 0.0312 | 0.001 |
| 82 | A108G_Q161S | 0.0175 | 0.0087 | 0.0033 | 0.0012 |
| 83 | A108G_G205M | 0.0263 | 0.1237 | 0.0035 | 0.0033 |
| 84 | Q161S_G205M | 0.0697 | 0.0405 | 0.0074 | 0.0042 |
| 85 | F123H_L174V | 0.1042 | 0.6771 | 0.0176 | 0.0066 |
| 86 | F123H_S177E | 0.1582 | 0.2375 | 0.0296 | 0.013 |
| 87 | L174V_S177E | 0.3606 | 1.3093 | 0.075 | 0.0057 |
| 88 | A53T_D166E | 0.0895 | 0.8308 | 0.0134 | 0.0086 |
| 89 | A53T_Q295W | 0.8241 | 1.2303 | 0.1612 | 0.0259 |
| 90 | D166E_Q295W | 0.1797 | 0.1318 | 0.0345 | 0.0045 |
| 91 | A53Q_S177Y | 0.0386 | 0.2353 | 0.0008 | 0.001 |
| 92 | A53Q_Y288H | 1.1458 | 0.1285 | 0.2604 | 0.0705 |
| 93 | S177Y_Y288H | 0.2683 | 0.0491 | 0.0629 | 0.0326 |
| 94 | V49A_Q161S | 0.0848 | 0.0242 | 0.0043 | 0.0136 |
| 95 | V49A_V294A | 0.1831 | 0.1548 | 0.0187 | 0.1053 |
| 96 | Q161S_V294A | 0.3405 | 0.0888 | 0.0409 | 0.017 |
| 97 | A53T_M106E | 0.1477 | 1.1549 | 0.0278 | 0.0164 |
| 98 | A53T_Q161S | 0.2004 | 0.2315 | 0.0309 | 0.0102 |
| 99 | M106E_Q161S | 0.0351 | 0.0166 | 0.0018 | 0.0003 |
| 100 | A53T_K118N | 0.0219 | 0.0473 | 0.0011 | 0.0015 |
| 101 | A53T_S214F | 0.419 | 0.0873 | 0.0203 | 0.0021 |
| 102 | A53T_S214F | 0.2654 | 0.0578 | 0.0172 | 0.0003 |
| 103 | K118N_S214F | 0.0175 | 0.0049 | 0.0019 | 0.0005 |
| 104 | A108G | 0.0599 | 0.1243 | 0.0055 | 0.0072 |
| 105 | A53Q | 0.2319 | 0.6862 | 0.0317 | 0.0245 |
| 106 | A53T | 0.3639 | 1.6305 | 0.0657 | 0.0512 |
| 107 | D166E | 0.1258 | 0.3017 | 0.0142 | 0.0142 |

TABLE 6-continued

HPLC Area in mAU*min of prenylation products produced by Orf2 and Orf2 Variants when using OA as substrate and FPP as donor

| ID # | Mutations | CBFA (8.362) | 5-FOA (8.805) | 9.912 | 11.127 |
|---|---|---|---|---|---|
| 108 | F123H | 0.1956 | 1.2205 | 0.0267 | 0.0182 |
| 109 | G205M | 0.1938 | 0.4822 | 0.028 | 0.0239 |
| 110 | K118N | 0.0428 | 0.0311 | 0.0033 | 0.0041 |
| 111 | L219F | 0.238 | 0.3455 | 0.0294 | 0.0182 |
| 112 | M106E | 0.1225 | 0.22 | 0.016 | 0.009 |
| 113 | Q161S | 0.2429 | 0.0598 | 0.018 | 0.0124 |
| 114 | Q295A | 0.8382 | 0.0761 | 0.1166 | 0.0875 |
| 115 | Q295W | 1.9456 | 0.8959 | 0.3114 | 0.0499 |
| 116 | Q38G | 0.1711 | 0.2818 | 0.0205 | 0.0148 |
| 117 | S177E | 0.4291 | 0.7748 | 0.0814 | 0.0097 |
| 118 | S177W | 0.413 | 0.063 | 0.0516 | 0.0068 |
| 119 | S177Y | 0.1073 | 0.3639 | 0.0116 | 0.0073 |
| 120 | S214F | 0.1109 | 0.0123 | 0.0049 | 0.0003 |
| 121 | V294A | 0.6188 | 0.7227 | 0.116 | 0.0796 |
| 122 | V294N | 0.4098 | 0.4108 | 0.0658 | 0.0468 |
| 123 | V49A | 0.1007 | 0.1018 | 0.0078 | 0.0547 |
| 124 | Y288H | 0.8326 | 0.0421 | 0.2104 | 0.0651 |
| 125 | L174V | 0.1059 | 0.2303 | 0.0054 | 0.0001 |
| 126 | K118Q | 0.0552 | 0.4075 | 0.0026 | 0.0059 |
| 127 | K119Q | 0.0324 | 0.0065 | 0.0002 | 0.0009 |
| 128 | M162A | 0.2073 | 1.955 | 0.0047 | 0.0002 |
| 129 | Q161A | 0.1357 | 0.275 | 0.018 | 0.0002 |
| 130 | K119D | 0.4031 | 0.9068 | 0.0716 | 0.0345 |
| 131 | G205L | 0.0817 | 0.1663 | 0.0084 | 0.0028 |
| 132 | F123A | 0.2341 | 0.691 | 0.0132 | 0.0055 |
| 133 | K118N | 0.0586 | 0.0546 | 0.0038 | 0.0052 |
| 134 | Q161W | 0.0338 | 0.0509 | 0.0005 | 0.0004 |
| 135 | D227E | 0.1383 | 0.4327 | 0.0148 | 0.0085 |
| 136 | L274V | 0.0556 | 0.097 | 0.0057 | 0.0038 |
| 137 | S214G | 0.1263 | 1.6669 | 0.0083 | 0.0591 |
| 138 | Y216A | 0.0268 | 0.0101 | 0.0003 | 0.0016 |
| 139 | F123W | 0.0141 | 0.0016 | 0.0006 | 0.0005 |
| 140 | V271E | 0.0421 | 0.0026 | 0.003 | 0.0001 |
| 141 | N173D | 0.021 | 0.0092 | 0.0001 | 0.0008 |
| 142 | R228Q | 0.024 | 0.0132 | 0.0022 | 0.001 |
| 143 | M162F | 0.1353 | 0.0125 | 0.0066 | 0.0009 |
| 144 | A232S | 0.5723 | 0.1803 | 0.1545 | 0.0491 |
| 145 | C230S | 0.0757 | 0.1728 | 0.0066 | 0.0021 |
| 146 | V294F | 0.4803 | 2.0674 | 0.0981 | 0.0128 |
| 147 | Y283L | 0.0723 | 0.2549 | 0.0074 | 0.0055 |
| 148 | S214R | 2.6729 | 0.0111 | 1.0301 | 0.0001 |
| 149 | G286E | 0.0452 | 0.0018 | 0.0113 | 0.001 |
| 150 | R228E | 0.0207 | 0.0028 | 0.0007 | 0.0015 |
| 151 | A53T_V294A | 1.2801 | 4.4539 | 0.3203 | 0.1968 |
| 152 | A53T_Q161S_V294A | 0.6708 | 0.4255 | 0.0842 | 0.0324 |
| 153 | A53T_Q161S_V294N | 0.4581 | 0.2995 | 0.061 | 0.0189 |
| 154 | A53T_Q295A | 1.5217 | 0.4336 | 0.2762 | 0.1661 |
| 155 | Q161S_V294A_Q295A | 2.5023 | 0.1045 | 0.3414 | 0.1399 |
| 156 | A53T_Q161S_Q295A | 1.3626 | 0.1371 | 0.2047 | 0.105 |
| 157 | A53T_V294A_Q295A | 4.3273 | 1.3268 | 0.6703 | 0.4987 |
| 158 | A53T_Q161S_V294A_Q295A | 2.8853 | 0.3387 | 0.4617 | 0.1904 |
| 159 | A53T_Q161S_V294N_Q295A | 1.4672 | 0.2062 | 0.1978 | 0.0576 |
| 160 | A53T_Q295W | 1.6479 | 2.2176 | 0.3642 | 0.0765 |
| 161 | Q161S_V294A_Q295W | 1.2893 | 0.2403 | 0.1614 | 0.0301 |
| 162 | A53T_Q161S_Q295W | 1.4412 | 0.6035 | 0.1903 | 0.0435 |
| 163 | A53T_V294A_Q295W | 1.2563 | 2.3283 | 0.3211 | 0.045 |
| 164 | A53T_Q161S_V294A_Q295W | 1.1775 | 0.5735 | 0.1538 | 0.0295 |
| 165 | A53T_Q161S_V294N_Q295W | 1.444 | 0.6805 | 0.2147 | 0.0557 |
| 166 | Q295A | 1.2973 | 0.1366 | 0.2239 | 0.1282 |
| 167 | Q295C | 2.4432 | 0.2588 | 0.3477 | 0.6523 |
| 168 | Q295E | 0.1742 | 0.0291 | 0.0165 | 0.0091 |
| 169 | Q295F | 9.5776 | 0.161 | 0.9022 | 0.3048 |
| 170 | Q295G | 0.5974 | 0.154 | 0.0941 | 0.0493 |
| 171 | Q295H | 0.9041 | 0.8249 | 0.1998 | 0.0832 |
| 172 | Q295I | 1.6234 | 0.0823 | 0.4239 | 0.0799 |
| 173 | Q295L | 4.7247 | 0.1617 | 0.7663 | 0.1983 |
| 174 | Q295M | 5.4574 | 0.357 | 0.9295 | 0.2639 |
| 175 | Q295N | 0.4216 | 0.2727 | 0.0595 | 0.0407 |
| 176 | Q295P | 0.352 | 0.096 | 0.0509 | 0.0497 |
| 177 | Q295R | 0.0571 | 0.0472 | 0.0006 | 0.0008 |
| 178 | Q295S | 0.3584 | 0.1364 | 0.049 | 0.0364 |
| 179 | Q295T | 0.1858 | 0.0365 | 0.0178 | 0.0117 |
| 180 | Q295V | 3.1982 | 0.1284 | 0.5856 | 0.2998 |
| 181 | Q295W | 2.2854 | 1.119 | 0.4268 | 0.0829 |

TABLE 6-continued

HPLC Area in mAU*min of prenylation products produced by Orf2 and Orf2 Variants when using OA as substrate and FPP as donor

| ID # | Mutations | CBFA (8.362) | 5-FOA (8.805) | 9.912 | 11.127 |
|---|---|---|---|---|---|
| 182 | Q295Q | 0.3695 | 0.6915 | 0.0572 | 0.0353 |
| 183 | Q295D | 0.5936 | 0.6559 | 0.0506 | 0.0265 |
| 184 | Q295K | 0.043 | 0.0377 | 0.0026 | 0.0021 |
| 185 | Q295Y | 0.2928 | 0.6636 | 0.0299 | 0.0143 |
| 186 | S214K | 0.0621 | 0.0164 | 0.005 | 0.001 |
| 187 | S214D | 0.1715 | 0.3347 | 0.0508 | 0.0009 |
| 188 | S214E | 0.1067 | 0.0137 | 0.0037 | 0.0002 |
| 189 | S214F | 0.143 | 0.0128 | 0.0042 | 0.001 |
| 190 | S214H | 1.2012 | 0.0141 | 0.2169 | 0.0007 |
| 191 | S214I | 0.2546 | 0.1171 | 0.0358 | 0.0019 |
| 192 | S214L | 0.0477 | 0.0039 | 0.0007 | 0.0003 |
| 193 | S214M | 0.0765 | 0.0092 | 0.0046 | 0.0007 |
| 194 | S214N | 0.1199 | 0.2288 | 0.0049 | 0.0016 |
| 195 | S214R | 2.4199 | 0.0085 | 0.8583 | 0.0006 |
| 196 | S214T | 0.3093 | 0.6422 | 0.0376 | 0.007 |
| 197 | S214V | 0.2486 | 0.5062 | 0.0275 | 0.0116 |
| 198 | S214W | 0.0202 | 0.0153 | 0.0013 | 0.0005 |
| 199 | S214Y | 0.0297 | 0.0058 | 0.0024 | 0.001 |
| 200 | S214C | 97.6105 | 0.0363 | 0.0584 | 0.0036 |
| 201 | S214P | 100.4364 | 0.0068 | 0.0005 | 0.0002 |
| 202 | Q161D | 0.0711 | 0.0036 | 0.0065 | 0.0036 |
| 203 | Q161P | 0.0752 | 0.0658 | 0.0056 | 0.0031 |
| 204 | Q161W | 0.0553 | 0.0372 | 0.0027 | 0.0023 |
| 205 | Q161A | 0.1471 | 0.346 | 0.0073 | 0.0015 |
| 206 | Q161H | 11.4099 | 0.1017 | 0.4454 | 0.0085 |
| 207 | Q161K | 0.3091 | 0.1306 | 0.0115 | 0.0005 |
| 208 | Q161G | 0.0685 | 0.0403 | 0.0067 | 0.0003 |
| 209 | Q161N | 0.1186 | 0.232 | 0.0126 | 0.0044 |
| 210 | Q161Q | 0.2108 | 0.3526 | 0.0156 | 0.0107 |
| 211 | Q161C | 0.0424 | 0.0787 | 0.009 | 0.0016 |
| 212 | Q161F | 0.3662 | 0.0404 | 0.1285 | 0.001 |
| 213 | Q161I | 0.0683 | 0.1596 | 0.0195 | 0.001 |
| 214 | Q161L | 0.16 | 0.1715 | 0.0323 | 0.0027 |
| 215 | Q161L | 0.1361 | 0.1589 | 0.024 | 0.0024 |
| 216 | Q161M | 0.1041 | 0.0444 | 0.0587 | 0.001 |
| 217 | Q161R | 0.5209 | 0.0589 | 0.013 | 0.0005 |
| 218 | Q161S | 0.0787 | 0.0319 | 0.0053 | 0.0007 |
| 219 | Q161T | 0.0924 | 0.1156 | 0.0088 | 0.0001 |
| 220 | Q161Y | 0.5214 | 0.0721 | 0.0747 | 0.0006 |
| 221 | A53I | 0.16 | 0.2559 | 0.0183 | 0.0403 |
| 222 | A53R | 0.0876 | 0.2113 | 0.0131 | 0.0157 |
| 223 | A53T | 0.373 | 2.0303 | 0.0699 | 0.0515 |
| 224 | A53W | 0.05 | 0.0607 | 0.0023 | 0.0033 |
| 225 | A53F | 0.0628 | 0.0091 | 0.0006 | 0.0006 |
| 226 | A53H | 0.0284 | 0.0202 | 0.001 | 0.0004 |
| 227 | A53M | 0.2911 | 0.9775 | 0.0241 | 0.0108 |
| 228 | A53N | 0.0364 | 0.1413 | 0.0025 | 0.0029 |
| 229 | A53S | 0.2729 | 0.8235 | 0.0326 | 0.0168 |
| 230 | A53V | 0.6655 | 1.0265 | 0.0983 | 0.0886 |
| 231 | A53G | 0.0926 | 0.2434 | 0.008 | 0.0037 |
| 232 | A53D | 0.0183 | 0.1077 | 0.0019 | 0.0007 |
| 233 | A53E | 0.0084 | 0.0033 | 0.0038 | 0.0001 |
| 234 | A53K | 0.0685 | 0.3496 | 0.0066 | 0.0013 |
| 235 | A53L | 0.1834 | 0.7254 | 0.0157 | 0.007 |
| 236 | A53Q | 0.0863 | 0.467 | 0.0096 | 0.0023 |
| 237 | A53Y | 0.0061 | 0.0079 | 0.0011 | 0.0006 |
| 238 | A53P | 95.3201 | 0.0071 | 0.0022 | 0.001 |
| 239 | S177W_Q295A | 10.3347 | 0.0119 | 0.4254 | 0.018 |
| 240 | S177W_S214R | 1.0699 | 0.006 | 0.2282 | 0.0008 |
| 241 | Q161S_S177W | 1.1284 | 0.0491 | 0.0608 | 0.0008 |
| 242 | A53T_S177W | 0.6999 | 0.4495 | 0.0652 | 0.0016 |
| 243 | V49A_Q295L | 0.0897 | 0.0156 | 0.0022 | 0.0027 |
| 244 | V49A_S214R | 0.9325 | 0.0111 | 0.1636 | 0.0004 |
| 245 | A53T_Q295F | 6.8272 | 0.4389 | 0.7712 | 0.0424 |
| 246 | A53T_S214R | 3.1427 | 0.0235 | 0.8942 | 0.001 |
| 247 | A53T_A161S | 0.1628 | 0.2227 | 0.0092 | 0.0024 |
| 248 | Q161S_Q295F | 5.0185 | 0.0458 | 0.2117 | 0.0855 |
| 249 | Q161S_Q295L | 5.2287 | 0.0436 | 0.2094 | 0.0662 |
| 250 | Q16S_S214R | 0.2075 | 0.0096 | 0.0381 | 0.0002 |
| 251 | S214R_Q295F | 10.6601 | 0.0249 | 0.8303 | 0.0009 |
| 252 | WT | 0.2877 | 0.5108 | 0.0499 | 0.0352 |
| 253 | WT | 0.3659 | 0.8081 | 0.0581 | 0.0309 |
| 254 | WT | 0.1106 | 0.2415 | 0.0156 | 0.0072 |
| 255 | WT | 0.2593 | 0.5299 | 0.0243 | 0.0071 |

TABLE 6-continued

| HPLC Area in mAU*min of prenylation products produced by Orf2 and Orf2 Variants when using OA as substrate and FPP as donor | | | | | |
|---|---|---|---|---|---|
| ID # | Mutations | CBFA (8.362) | 5-FOA (8.805) | 9.912 | 11.127 |
| 256 | WT | 0.2069 | 0.4128 | 0.017 | 0.005 |
| 257 | WT | 0.1014 | 0.2634 | 0.0143 | 0.0028 |

Figure 3:
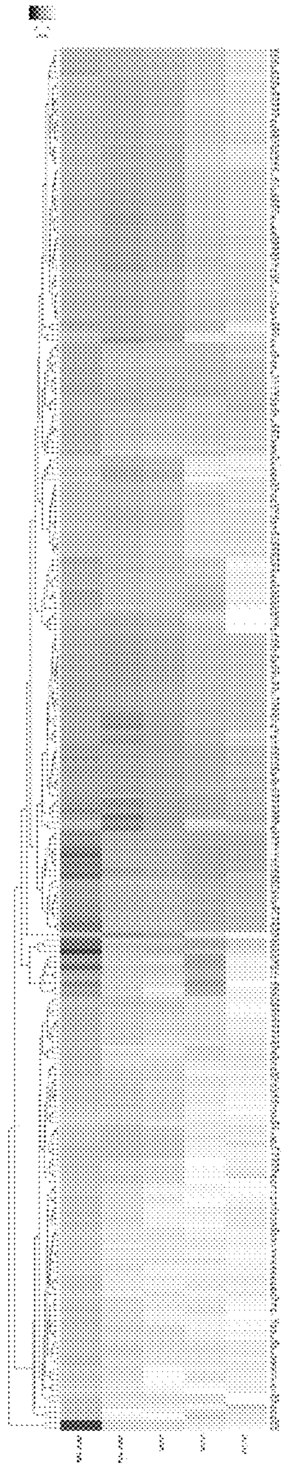
FIG. 3 shows a heatmap of prenylated products produced from Orf2 mutants when using OA as substrate and FPP as donor.

The amount of each prenylation product was measured by HPLC. FIG. 3 shows a heatmap of the HPLC areas of each prenylation product generated using OA as substrate and FPP as donor. Each column represents a single prenylation product and each row represents an Orf2 or Orf2 variant. Prenylation products are labeled by retention time. Enzyme variants are labeled by ID #as listed in Table 6.

Example 5: Generation of ORF2 Variants which Synthesize an Altered Amount of Prenylated Products when Using O as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position.

The wild type Orf2 prenylation reaction using O as substrate and GPP as donor produces 3 products as detected by HPLC. The respective retention times of these products are approximately 7.095 [CBG], 7.745 [5-GO], and 8.563 minutes.

Table 7A provides a summary of the prenylation products produced from O and GPP, their retention times, and the hypothesized prenylation site on O. FIG. 19 shows the predicted chemical structures of the respective prenylation products.

TABLE 7A

| Predicted prenylation products of Orf2 or Orf2 Mutants when using O as substrate and GPP as donor | | | | |
|---|---|---|---|---|
| Molecule ID | Substrate | Donor | Attachment Site | Retention Time |
| RBI-03 (5-GO) | O | GPP | 1-C/5-C | 7.745 |
| RBI-20 | O | GPP | 2-O/4-O | 8.563 |
| RBI-01 (CBG) | O | GPP | 3-C | 7.095 |

Figure 83:
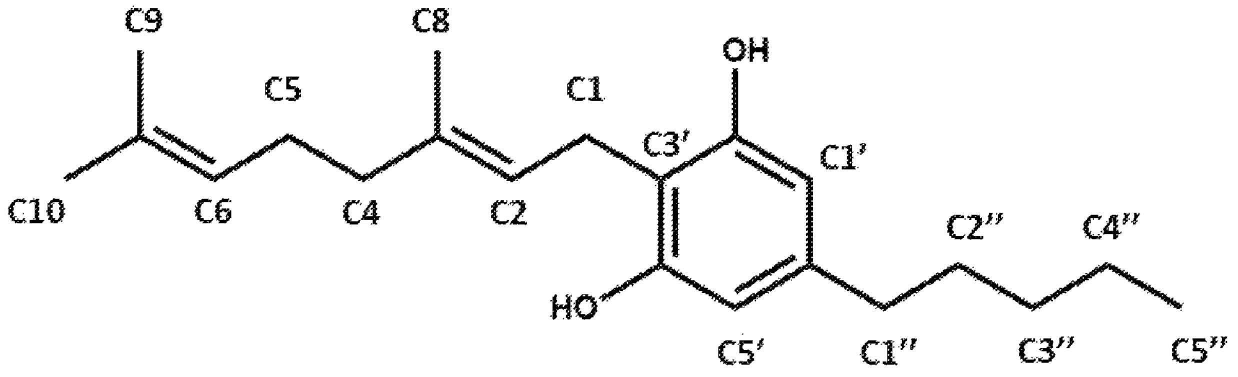
FIG. 83: Carbon and proton NMR assignments for CBG.

Tables 7B-7D provide NMR data of proton and carbon chemical shifts for CBG with (a) HSQC, (b) HMBC correlation and (c) final carbon and proton NMR assignments. The carbon and proton NMR assignments for CBG are shown in FIG. 83.

TABLE 7B

| Proton NMR assignments for CBG | | | | | | |
|---|---|---|---|---|---|---|
| PROTON | | Pro- | C | HSQC- | MULTIPLICITY | |
| Shift | Area | tons | Assignment | DEPT | Options | Actual |
| 0.861 | 3.3 | 3 | C5" | 0.85 | CH1 or CH3 | CH3 |
| 1.245 | 2.09 | 2 | C3" Or C4" | 1.23 | CH2 | CH2 |
| 1.288 | 1.97 | 2 | C3" Or C4" | 1.27 | CH2 | CH2 |
| 1.474 | 2.08 | 2 | C2" | 1.46 | CH2 | CH2 |
| 1.535 | 2.76 | 3 | C10 | 1.52 | CH1 or CH3 | CH3 |
| 1.608 | 2.99 | 3 | C9 | X | X | CH3 |
| 1.695 | 2.74 | 3 | C8 | 1.68 | CH1 or CH3 | CH3 |
| 1.887 | 1.86 | 2 | C5 | 1.88 | CH2 | CH2 |
| 1.988 | 1.87 | 2 | C4 | 1.98 | CH2 | CH2 |
| 2.324 | 2.01 | 2 | C1" | 2.31 | CH2 | CH2 |
| 3.13 | 1.88 | 2 | C1 | 3.12 | CH2 | CH2 |
| 5.051 | 1 | 1 | C6 | 5.04 | CH1 or CH3 | CH |
| 5.167 | 1.09 | 1 | C2 | 5.16 | CH1 or CH3 | CH |
| 6.084 | 2.12 | 2 | C1' + C5' | 6.08 | CH1 or CH3 | CH2 |
| 8.857 | 2.01 | 2 | C2' + C4' | | X | X |
| | H Sum: | 32 | | | | |

TABLE 7C

| Carbon NMR assignments for CBG | | | |
|---|---|---|---|
| CARBON Shift | Assignment | Carbon ct. | NMR Predictions |
| 14.39 | C5" | 1 | 14.1 |
| 16.37 | C8 | 1 | 16.4 |
| 18 | C9 | 1 | 18.6 |
| 22.26 | C1 | 1 | 21.9 |
| 22.47 | C4" | 1 | 22.7 |
| 25.95 | C10 | 1 | 24.6 |
| 26.73 | C5 | 1 | 26.4 |
| 30.96 | C2" | 1 | 30.9 |
| 31.36 | C3" | 1 | 31.4 |
| 35.48 | C1" | 1 | 36.3 |
| 38.543 | C4 | 1 | 39.7 |
| 106.7 | C1' + C5' | 2 | 107.5 |
| 111.89 | C3' | 1 | 113.4 |
| 124.09 | C2 | 1 | 122.3 |
| 124.68 | C6 | 1 | 123.5 |
| 131.04 | C7 | 1 | 132 |
| 133.08 | C3 | 1 | 136.5 |
| 140.637 | C6' | 1 | 143.2 |
| 147.7 | C4' Or C2' | 1 | 155.9 |
| 156.14 | C4' Or C2' | 1 | 155.9 |
| | SUM | 21 | |

TABLE 7D

| HMBC for sample CBG | | | | | | | | |
|---|---|---|---|---|---|---|---|---|
| 1D C C Shift | Assignment | Associated Proton Shifts | | | Proton List | | | |
| 14.39 | C5" | 0.75 | | | C3" | | | |
| 16.37 | C8 | 1.89 | 5.16 | | C5 | C2 | | |
| 18 | C9 | 1.42 | 5.05 | | C2" | C6 | | |
| 22.26 | C1 | X | | | X | | | |
| 22.47 | C4" | 0.86 | | | C3" | | | |
| 25.95 | C10 | X | | | X | | | |
| 26.73 | C5 | 1.88 | | | C5 | | | |
| 30.96 | C2" | X | | | X | | | |
| 31.36 | C3" | 1.47 | 1.29 | 2.32 | C2" | C3" Or C4" | C1" | |
| 35.48 | C1" | 1.47 | 6.08 | | C2" | C1' + C5' | | |
| 38.543 | C4 | 1.77 | 5.16 | | C8 | C2 | | |
| 106.7 | C1' + C5' | 8.86 | 2.33 | 6.08 | C2' + C4' | C1" | C1' + C5' | |
| 111.89 | C3' | 3.12 | 8.86 | 6.08 | C1 | C2' + C4' | C1' + C5' | |
| 124.06 | C2 | 3.12 | | | C1 | | | |
| 124.68 | C6 | 1.6 | 1.89 | | C9 | | | |
| 131.04 | C7 | 1.53 | | | C10 | | | |
| 133.08 | C3 | 1.69 | 3.12 | 1.87 | C8 | C1 | C5 | |
| 140.637 | C6' | 2.32 | 1.46 | | C1" | C2" | | |
| 154.7 | C4' Or C2' | 8.86 | | | C2' + C4' | | | |
| 156.14 | C4' Or C2' | 3.12 | 8.86 | | C1 | C2' + C4' | | |

Table 8 provides a summary of the analysis performed on the enzymatic activity of the ORF2 variants to produce prenylated products using O as substrate and GPP as donor. Table 8 lists the mutations within each of the mutants analyzed as well mAU*min areas from the HPLC analysis of the reaction products.

TABLE 8

| HPLC Area in mAU*min of prenylation products produced by Orf2 and Orf2 Variants when using O as substrate and GPP as donor | | | | |
|---|---|---|---|---|
| ID # | Mutations | CBG (7.095) | 5GO (7.745) | 8.563 |
| 1 | V9_Q38G_E112D_F123H | 0.3065 | 0.4033 | 0.2568 |
| 2 | V17_V49L_F123A_Y283L | 0.1942 | 0.2095 | 0.1733 |
| 3 | V25_L219F_V294N_Q295A | 0.5735 | 0.4173 | 0.1966 |
| 4 | V33_A17T_C25V_E112G | 0.3182 | 0.3457 | 0.2034 |
| 5 | V49_G205L_R228E_C230N | 0.194 | 0.2399 | 0.1871 |
| 6 | V57_C25V_A232S_V271E | 0.1891 | 0.2273 | 0.1895 |
| 7 | V65_V49A_Q161S_V294A | 0.703 | 0.8977 | 0.2565 |
| 8 | V73_V49S_K118Q_S177E | 0.2141 | 0.2994 | 0.2057 |
| 9 | V81_V49L_D166E_L274V | 0.2202 | 0.2631 | 0.2112 |
| 10 | V89_Y121W_S177Y_G286E | 0.2499 | 0.3016 | 0.243 |
| 11 | V10_V49A_S177Y_C209G | 0.2202 | 0.2682 | 0.2271 |
| 12 | V26_A53E_A108G_K118N | 0.2397 | 0.2981 | 0.2248 |
| 13 | V34_A53Q_Y121W_A232S | 0.2661 | 0.3326 | 0.2679 |
| 14 | V42_D166E_S177Y_S214F | 0.2696 | 0.3306 | 0.2763 |
| 15 | V58_K118Q_L174V_R228Q | 0.3098 | 0.3717 | 0.3178 |
| 16 | V66_C25V_F213M_Y216A | 0.2775 | 0.3398 | 0.2835 |
| 17 | V74_M106E_Y121W_D166E | 0.2878 | 0.3451 | 0.2929 |
| 18 | V82_V49S_K119D_F213M | 0.2217 | 0.2841 | 0.235 |
| 19 | V90_A17T_F123W_L298A | 0.2115 | 0.2931 | 0.1939 |
| 20 | V3_V49S_M162A_Y283L | 0.2213 | 0.7384 | 0.2139 |
| 21 | V11_K118N_K119A_V271E | 0.2744 | 0.3159 | 0.2583 |
| 22 | V19_V49L_S214R_V271E | 0.2545 | 0.3185 | 0.258 |
| 23 | V35_A53Q_S177Y_Y288H | 0.371 | 0.703 | 0.2559 |
| 24 | V43_Q161A_M162F_Q295A | 1.8681 | 0.787 | 0.3027 |
| 25 | V51_V49L_K119D_G205M | 0.2333 | 0.3044 | 0.2386 |
| 26 | V59_V49S_S214G_V294A | 0.2284 | 0.4829 | 0.2326 |
| 27 | V67_A108G_K119D_L298A | 0.211 | 0.2503 | 0.1988 |
| 28 | V75_A53Q_L274V_Q295A | 0.2286 | 0.298 | 0.2172 |
| 29 | V83_E112D_L219F_V294F | 0.8983 | 0.8995 | 0.3051 |
| 30 | V91_N173D_F213M_V294F | 0.2854 | 0.6328 | 0.2284 |
| 31 | V4_K118Q_Q161W_S214F | 0.2761 | 0.3493 | 0.235 |
| 32 | V20_D227E_C230N_Q295W | 0.2291 | 0.2973 | 0.2118 |
| 33 | V28_A53T_D166E_Q295W | 0.405 | 0.6084 | 0.2292 |
| 34 | V44_A53E_Q161A_V294N | 0.5894 | 0.7298 | 0.2042 |
| 35 | V52_K119A_S214G_L298A | 0.1708 | 0.2959 | 0.1305 |
| 36 | V60_E112D_K119A_N173D | 0.1903 | 0.2403 | 0.1585 |
| 37 | V68_K118N_C209G_R228Q | 0.2002 | 0.2477 | 0.1604 |
| 38 | V76_V49A_F123A_Y288H | 0.136 | 0.1827 | 0.1209 |
| 39 | V84_F123H_L174V_S177E | 0.2886 | 0.3135 | 0.1886 |

TABLE 8-continued

HPLC Area in mAU*min of prenylation products produced by Orf2 and Orf2 Variants when using O as substrate and GPP as donor

| ID # | Mutations | CBG (7.095) | 5GO (7.745) | 8.563 |
|---|---|---|---|---|
| 40 | V92_A53T_E112D_G205M | 1.5896 | 1.2489 | 0.204 |
| 41 | V69_A53T_M106E_Q161S | 3.1916 | 1.3656 | 0.1869 |
| 42 | V60_E112D_K119A_N173D | 0.2314 | 0.2803 | 0.1361 |
| 43 | V62_A53T_N173D_S214R | 0.2207 | 0.2818 | 0.1661 |
| 44 | V70_Q38G_D166E_Q295A | 0.3134 | 0.3094 | 0.1762 |
| 45 | V78_K119D_Q161W_L298Q | 0.2054 | 0.2715 | 0.1388 |
| 46 | V94_A17T_V49A_C230N | 0.2159 | 0.2812 | 0.1529 |
| 47 | V15_A53E_F213M_R228Q | 0.2077 | 0.302 | 0.1532 |
| 48 | V23_L219F_Y283L_L298W | 0.2448 | 0.4232 | 0.143 |
| 49 | V31_D227E_R228E_L298Q | 0.1989 | 0.2764 | 0.1624 |
| 50 | V39_A53T_K118N_S214F | 0.2765 | 0.3188 | 0.1231 |
| 51 | V47_K118Q_F123A_R228E | 0.2329 | 0.3136 | 0.153 |
| 52 | V55_V49S_Y216A_V294N | 0.2206 | 0.3124 | 0.147 |
| 53 | V71_M106E_G205L_C209G | 0.2391 | 0.323 | 0.164 |
| 54 | V79_V49A_Y121W_C230S | 0.2207 | 0.299 | 0.1552 |
| 55 | V87_S177W_Y288H_V294N | 0.2266 | 0.3002 | 0.1614 |
| 56 | V95_A17T_Q161W_A232S | 1.0678 | 0.4634 | 0.1861 |
| 57 | V8_K119A_Q161A_R228Q | 0.24 | 0.3273 | 0.1598 |
| 58 | V16_A53Q_S177W_L219F | 0.4683 | 0.4481 | 0.2006 |
| 59 | V32_M162A_C209G_Y288H | 0.1947 | 0.2801 | 0.1537 |
| 60 | V40_S177E_S214R_R228E | 0.2652 | 0.3543 | 0.2028 |
| 61 | V48_V49L_E112D_G286E | 0.3004 | 0.3258 | 0.1862 |
| 62 | V56_F123A_M162F_S214G | 0.2201 | 0.3228 | 0.1673 |
| 63 | V72_E112G_G205M_L298W | 0.355 | 0.6902 | 0.1787 |
| 64 | V80_M162A_N173D_S214F | 0.3072 | 0.5322 | 0.1732 |
| 65 | V88_A108G_Q161S_G205M | 0.4996 | 0.4828 | 0.2088 |
| 66 | V64_M106E_M162A_Y216A | 0.1974 | 0.246 | 0.1603 |
| 67 | V63_F123W_M162F_C209G | 0.0917 | 0.1395 | 0.1304 |
| 68 | V24_A17T_F213M_S214R | 0.3021 | 0.3802 | 0.2112 |
| 69 | V36_F123H_L274V_L298A | 0.1982 | 0.2554 | 0.1354 |
| 70 | Q38G_D166E | 0.2704 | 0.3073 | 0.1579 |
| 71 | Q38G_Q295A | 0.8428 | 0.6827 | 0.2238 |
| 72 | D166E_Q295A | 0.5788 | 0.4059 | 0.1779 |
| 73 | L219F_V294N | 1.186 | 0.9075 | 0.2028 |
| 74 | L219F_Q295A | 0.5993 | 0.4027 | 0.1356 |
| 75 | V294N_Q295A | 1.9865 | 1.1733 | 0.2227 |
| 76 | A53Q_S177W | 0.4935 | 0.3688 | 0.1697 |
| 77 | A53Q_L219F | 0.4909 | 0.5052 | 0.1725 |
| 78 | S177W_L219F | 0.4067 | 0.3348 | 0.1599 |
| 79 | A108G_Q161S | 0.4665 | 0.4112 | 0.2023 |
| 80 | A108G_G205M | 0.3021 | 0.3478 | 0.181 |
| 81 | Q161S_G205M | 0.9204 | 0.5004 | 0.1039 |
| 82 | F123H_L174V | 0.2572 | 0.3425 | 0.1635 |
| 83 | F123H_S177E | 0.3424 | 0.3082 | 0.1772 |
| 84 | L174V_S177E | 0.7942 | 0.6381 | 0.2163 |
| 85 | A53T_D166E | 0.6316 | 0.6992 | 0.2206 |
| 86 | A53T_Q295W | 1.3244 | 1.2364 | 0.1855 |
| 87 | D166E_Q295W | 0.3642 | 0.5063 | 0.1428 |
| 88 | A53Q_S177Y | 0.5035 | 0.607 | 0.189 |
| 89 | A53Q_Y288H | 0.4187 | 1.1803 | 0.1699 |
| 90 | S177Y_Y288H | 0.3168 | 0.4557 | 0.1558 |
| 91 | V49A_Q161S | 0.7008 | 1.0062 | 0.2164 |
| 92 | V49A_V294A | 0.4574 | 0.6907 | 0.1735 |
| 93 | Q161S_V294A | 2.8501 | 1.1301 | 0.1967 |
| 94 | A53T_M106E | 2.0177 | 1.5187 | 0.237 |
| 95 | A53T_Q161S | 3.0733 | 1.3385 | 0.2506 |
| 96 | M106E_Q161S | 0.951 | 0.5947 | 0.1947 |
| 97 | A53T_K118N | 0.2334 | 0.3517 | 0.1228 |
| 98 | A53T_S214F | 6.4229 | 1.4309 | 0.4131 |
| 99 | A53T_S214F | 4.1685 | 1.0642 | 0.3362 |
| 100 | K118N_S214F | 0.2231 | 0.2519 | 0.1262 |
| 101 | A108G | 0.1192 | 0.1475 | 0.1146 |
| 102 | A53Q | 0.51 | 0.4795 | 0.1649 |
| 103 | A53T | 1.4988 | 1.0189 | 0.1734 |
| 104 | D166E | 0.3514 | 0.3681 | 0.1763 |
| 105 | F123H | 0.1357 | 0.1856 | 0.1306 |
| 106 | G205M | 0.6559 | 0.4994 | 0.1613 |
| 107 | K118N | 0.1983 | 0.2496 | 0.1537 |
| 108 | L219F | 0.4095 | 0.3989 | 0.1777 |
| 109 | M106E | 0.5112 | 0.435 | 0.1682 |
| 110 | Q161S | 1.4626 | 0.7537 | 0.1814 |
| 111 | Q295A | 1.0116 | 0.4067 | 0.1371 |
| 112 | Q295W | 0.8401 | 0.7437 | 0.1526 |
| 113 | Q38G | 0.336 | 0.3076 | 0.1473 |

TABLE 8-continued

HPLC Area in mAU*min of prenylation products produced by Orf2 and Orf2 Variants when using O as substrate and GPP as donor

| ID # | Mutations | CBG (7.095) | 5GO (7.745) | 8.563 |
|---|---|---|---|---|
| 114 | S177E | 0.5987 | 0.4703 | 0.1895 |
| 115 | S177W | 0.3765 | 0.2756 | 0.1434 |
| 116 | S177Y | 0.3691 | 0.3892 | 0.1566 |
| 117 | S214F | 1.6238 | 0.4704 | 0.1941 |
| 118 | V294A | 1.3204 | 0.8556 | 0.198 |
| 119 | V294N | 1.1311 | 0.7239 | 0.159 |
| 120 | Y288H | 0.2888 | 0.4703 | 0.1331 |
| 121 | V49A | 0.3386 | 0.4876 | 0.1878 |
| 122 | Q295A | 1.2977 | 0.5914 | 0.2119 |
| 123 | Q295W | 1.1485 | 1.066 | 0.259 |
| 124 | L174V | 0.2755 | 0.1437 | 0.0296 |
| 125 | K118Q | 0.1393 | 0.3647 | 0.1061 |
| 126 | K119Q | 0.063 | 0.0895 | 0.0623 |
| 127 | M162A | 0.0977 | 0.564 | 0.1246 |
| 128 | Q161A | 0.7044 | 0.5595 | 0.1193 |
| 129 | K119D | 0.7113 | 0.533 | 0.1274 |
| 130 | G205L | 0.1302 | 0.1256 | 0.0665 |
| 131 | F123A | 0.146 | 0.2765 | 0.1032 |
| 132 | K118N | 0.1298 | 0.2326 | 0.1285 |
| 133 | Q161W | 1.4229 | 0.329 | 0.1344 |
| 134 | D227E | 0.3969 | 0.3413 | 0.1133 |
| 135 | L274V | 0.1867 | 0.1766 | 0.1077 |
| 136 | S214G | 0.171 | 0.7571 | 0.1514 |
| 137 | Y216A | 0.1428 | 0.1533 | 0.1115 |
| 138 | F123W | 0.0811 | 0.1105 | 0.0873 |
| 139 | V271E | 0.1035 | 0.1322 | 0.1266 |
| 140 | N173D | 0.1867 | 0.1776 | 0.112 |
| 141 | R228Q | 0.1531 | 0.1972 | 0.1241 |
| 142 | M162F | 0.6655 | 0.3168 | 0.1161 |
| 143 | A232S | 1.6761 | 0.6551 | 0.1652 |
| 144 | C230S | 0.186 | 0.1798 | 0.1093 |
| 145 | V294F | 0.8439 | 0.6396 | 0.1292 |
| 146 | Y283L | 0.3707 | 0.3754 | 0.12 |
| 147 | S214R | 0.18 | 0.1577 | 0.1146 |
| 148 | G286E | 0.0963 | 0.1359 | 0.114 |
| 149 | R228E | 0.5308 | 0.4217 | 0.2098 |
| 150 | A53T_V294A | 4.3154 | 2.3259 | 0.3126 |
| 151 | A53T_Q161S_V294A | 5.3751 | 1.7353 | 0.2743 |
| 152 | A53T_Q161S_V294N | 4.8641 | 1.667 | 0.2765 |
| 153 | A53T_Q295A | 2.4689 | 0.8374 | 0.2766 |
| 154 | Q161S_V294A_Q295A | 5.1846 | 1.1046 | 0.314 |
| 155 | A53T_Q161S_Q295A | 6.5383 | 1.0823 | 0.3038 |
| 156 | A53T_V294A_Q295A | 4.2878 | 1.2019 | 0.288 |
| 157 | A53T_Q161S_V294A_Q295A | 6.8655 | 1.0392 | 0.3564 |
| 158 | A53T_Q161S_V294N_Q295A | 5.4091 | 1.0492 | 0.2815 |
| 159 | A53T_Q295W | 2.0002 | 1.6157 | 0.2086 |
| 160 | Q161S_V294A_Q295W | 2.6247 | 1.1964 | 0.2493 |
| 161 | A53T_Q161S_Q295W | 4.2451 | 1.5899 | 0.2071 |
| 162 | A53T_V294A_Q295W | 2.1217 | 1.2914 | 0.2998 |
| 163 | A53T_Q161S_V294A_Q295W | 4.1157 | 1.3136 | 0.2515 |
| 164 | A53T_Q161S_V294N_Q295W | 4.1445 | 1.2834 | 0.2092 |
| 165 | Q295C | 1.1112 | 0.6108 | 0.2639 |
| 166 | Q295E | 0.3485 | 0.5615 | 0.2689 |
| 167 | Q295F | 1.8946 | 1.0029 | 0.2393 |
| 168 | Q295G | 2.1139 | 0.7158 | 0.2253 |
| 169 | Q295H | 6.6017 | 2.9599 | 0.2678 |
| 170 | Q295I | 0.3872 | 0.4097 | 0.2505 |
| 171 | Q295L | 0.8165 | 0.5339 | 0.279 |
| 172 | Q295M | 2.2673 | 0.8435 | 0.253 |
| 173 | Q295N | 0.6222 | 0.5431 | 0.21 |
| 174 | Q295P | 0.3436 | 0.3472 | 0.1892 |
| 175 | Q295R | 0.2535 | 0.2964 | 0.2125 |
| 176 | Q295S | 0.6678 | 0.5267 | 0.2261 |
| 177 | Q295T | 0.5404 | 0.5097 | 0.2766 |
| 178 | Q295V | 0.4045 | 0.3997 | 0.2359 |
| 179 | Q295D | 0.7086 | 0.6476 | 0.187 |
| 180 | Q295K | 0.3478 | 0.418 | 0.2129 |
| 181 | Q295Y | 0.7029 | 0.6132 | 0.1873 |
| 182 | Q295A | 1.2977 | 0.5914 | 0.2119 |
| 183 | Q295W | 1.1485 | 1.066 | 0.259 |
| 184 | S214K | 0.268 | 0.1726 | 0.0856 |
| 185 | S214C | 0.1316 | 0.1527 | 0.0315 |
| 186 | S214D | 0.5941 | 0.4307 | 0.1566 |
| 187 | S214E | 4.3929 | 0.724 | 0.1754 |

TABLE 8-continued

HPLC Area in mAU*min of prenylation products produced by Orf2 and Orf2 Variants when using O as substrate and GPP as donor

| ID # | Mutations | CBG (7.095) | 5GO (7.745) | 8.563 |
|---|---|---|---|---|
| 188 | S214F | 1.7481 | 0.5769 | 0.2026 |
| 189 | S214H | 7.3615 | 0.3826 | 0.1521 |
| 190 | S214I | 1.1748 | 0.6441 | 0.222 |
| 191 | S214L | 1.0532 | 0.5453 | 0.1967 |
| 192 | S214M | 1.0082 | 0.5658 | 0.2189 |
| 193 | S214N | 1.9276 | 0.5276 | 0.2475 |
| 194 | S214R | 0.3476 | 0.3536 | 0.1495 |
| 195 | S214T | 0.6615 | 0.6016 | 0.198 |
| 196 | S214V | 0.5789 | 0.5238 | 0.1768 |
| 197 | S214W | 0.4247 | 0.3808 | 0.209 |
| 198 | S214Y | 0.487 | 0.4005 | 0.2027 |
| 200 | S214G | 0.0512 | 0.409 | 0.0463 |
| 201 | S214P | 0.0252 | 0.0391 | 0.0291 |
| 202 | S214Q | 8.4779 | 0.3014 | 0.0477 |
| 203 | Q161D | 1.0399 | 0.4872 | 0.1899 |
| 204 | Q161P | 0.1064 | 0.1022 | 0.0569 |
| 205 | Q161W | 0.7525 | 0.2667 | 0.154 |
| 206 | Q161A | 0.3657 | 0.343 | 0.0542 |
| 207 | Q161H | 5.7816 | 0.6558 | 0.2085 |
| 208 | Q161K | 0.2086 | 0.2366 | 0.0705 |
| 209 | Q161G | 1.2012 | 0.7311 | 0.1936 |
| 210 | Q161N | 0.8334 | 0.6653 | 0.1671 |
| 211 | Q161Q | 0.6143 | 0.5772 | 0.202 |
| 212 | Q161C | 1.8896 | 0.8687 | 0.2114 |
| 213 | Q161F | 7.2278 | 0.9128 | 0.1821 |
| 214 | Q161I | 3.4013 | 0.9068 | 0.2392 |
| 215 | Q161L | 5.3283 | 1.0625 | 0.1908 |
| 216 | Q161L | 4.9128 | 1.0446 | 0.2139 |
| 217 | Q161M | 3.4716 | 0.6675 | 0.205 |
| 218 | Q161R | 0.5188 | 0.5031 | 0.2032 |
| 219 | Q161S | 0.9388 | 0.5037 | 0.1905 |
| 220 | Q161T | 0.9365 | 0.6197 | 0.1915 |
| 221 | Q161Y | 5.467 | 0.9157 | 0.1691 |
| 222 | Q161E | 0.3212 | 0.3575 | 0.04 |
| 223 | Q161V | 0.9976 | 0.3447 | 0.054 |
| 224 | A53I | 1.0741 | 1.236 | 0.178 |
| 225 | A53R | 0.3302 | 0.3478 | 0.1714 |
| 226 | A53T | 1.6163 | 1.1007 | 0.2002 |
| 227 | A53W | 0.3676 | 0.3636 | 0.1472 |
| 228 | A53F | 0.142 | 0.1558 | 0.0545 |
| 229 | A53H | 0.1611 | 0.1991 | 0.0889 |
| 230 | A53M | 1.1404 | 0.9129 | 0.2386 |
| 231 | A53N | 0.3815 | 0.4335 | 0.2113 |
| 232 | A53S | 0.8135 | 0.696 | 0.198 |
| 233 | A53V | 1.5411 | 1.495 | 0.2286 |
| 234 | A53G | 0.443 | 0.5263 | 0.2207 |
| 235 | A53D | 0.3125 | 0.3139 | 0.1717 |
| 236 | A53E | 0.1933 | 0.2199 | 0.1851 |
| 237 | A53K | 0.5889 | 0.4933 | 0.1855 |
| 238 | A53L | 1.9059 | 1.3577 | 0.2164 |
| 239 | A53Q | 0.6045 | 0.5595 | 0.2097 |
| 240 | A53Y | 0.2169 | 0.284 | 0.161 |
| 241 | A53C | 0.415 | 0.308 | 0.0351 |
| 242 | A53P | 0.0561 | 0.0768 | 0.0527 |
| 243 | S177W_Q295A | 0.694 | 0.4575 | 0.0959 |
| 244 | S177W_S214R | 0.1776 | 0.2114 | 0.0831 |
| 245 | Q161S_S177W | 0.5912 | 0.4139 | 0.1082 |
| 246 | A53T_S177W | 0.9678 | 0.4316 | 0.0989 |
| 247 | V49A_Q295L | 0.2342 | 0.2992 | 0.0941 |
| 248 | V49A_S214R | 0.2154 | 0.2196 | 0.0938 |
| 249 | A53T_Q295F | 2.3515 | 0.773 | 0.1202 |
| 250 | A53T_S214R | 0.3473 | 0.2767 | 0.077 |
| 251 | A53T_A161S | 3.0213 | 1.1637 | 0.1421 |
| 252 | Q161S_Q295F | 2.6242 | 0.9004 | 0.1022 |
| 253 | Q161S_Q295L | 3.2538 | 1.0628 | 0.1334 |
| 254 | Q16S_S214R | 0.2947 | 0.2578 | 0.1119 |
| 255 | S214R_Q295F | 0.371 | 0.309 | 0.1276 |
| 256 | WT | 0.4172 | 0.3183 | 0.0367 |
| 258 | WT | 0.6835 | 0.606 | 0.2548 |
| 259 | WT | 0.7681 | 0.6793 | 0.2426 |
| 260 | WT | 0.6153 | 0.5887 | 0.2075 |
| 261 | WT | 0.6898 | 0.5861 | 0.2092 |
| 262 | WT | 0.5434 | 0.4288 | 0.152 |
| 263 | WT | 1.0129 | 0.8677 | 0.4139 |

TABLE 8-continued

HPLC Area in mAU*min of prenylation products produced by Orf2 and Orf2 Variants when using O as substrate and GPP as donor

| ID # | Mutations | CBG (7.095) | 5GO (7.745) | 8.563 |
|---|---|---|---|---|
| 264 | WT | 0.7708 | 0.6776 | 0.2865 |
| 265 | WT | 0.5786 | 0.4687 | 0.1302 |
| 266 | WT | 0.7036 | 0.5877 | 0.2007 |
| 267 | WT | 0.4344 | 0.3771 | 0.138 |
| 268 | WT | 0.6026 | 0.3457 | 0.0419 |
| 269 | Y288A | 1.0046 | 0.1104 | 0.152 |
| 270 | Y288C | 1.2257 | 0.2055 | 0.0993 |
| 271 | Y288D | 0.0238 | 0.0267 | 0.0221 |
| 272 | Y288E | 0.0181 | 0.0277 | 0.0216 |
| 273 | Y288F | 4.0602 | 0.9402 | 0.0843 |
| 274 | Y288G | 0.0974 | 0.0319 | 0.0176 |
| 275 | Y288H | 0.0747 | 0.2353 | 0.0297 |
| 276 | Y288I | 2.3134 | 0.4259 | 0.0745 |
| 277 | Y288K | 0.0334 | 0.0392 | 0.0242 |
| 278 | Y288L | 3.3977 | 0.5406 | 0.1476 |
| 279 | Y288M | 1.904 | 0.4272 | 0.053 |
| 280 | Y288P | 1.2987 | 0.238 | 0.1338 |
| 281 | Y288R | 0.0087 | 0.0048 | 0.0061 |
| 282 | Y288S | 0.1344 | 0.0574 | 0.0208 |
| 283 | Y288T | 1.3149 | 0.2483 | 0.0461 |
| 284 | Y288W | 0.6476 | 0.1843 | 0.031 |
| 285 | A232S | 1.3557 | 0.4728 | 0.0589 |
| 286 | N173D-S214R | 0.0034 | 0.006 | 0.0057 |
| 287 | N173D | 0.0309 | 0.0329 | 0.0145 |
| 288 | M162F | 0.427 | 0.1507 | 0.0417 |
| 289 | Y288Y | 0.3693 | 0.2484 | 0.0316 |
| 290 | A17T | 0.2115 | 0.1411 | 0.0301 |
| 291 | A232S | 1.2313 | 0.4976 | 0.0603 |
| 292 | M162F-Q295A | 1.4625 | 0.5356 | 0.0731 |
| 293 | WT | 0.203 | 0.179 | 0.036 |
| 294 | A232S | 0.195 | 0.123 | 0.056 |
| 295 | A232S | 0.192 | 0.119 | 0.05 |
| 296 | S214A | 0.128 | 0.196 | 0.047 |
| 297 | S214A | 0.144 | 0.229 | 0.047 |
| 298 | S214Q | 9.114 | 0.347 | 0.041 |
| 299 | S214Q | 8.816 | 0.41 | 0.057 |
| 300 | Q161E | 0.235 | 0.262 | 0.046 |
| 301 | Y288N | 0.203 | 0.197 | 0.158 |

Figure 4:
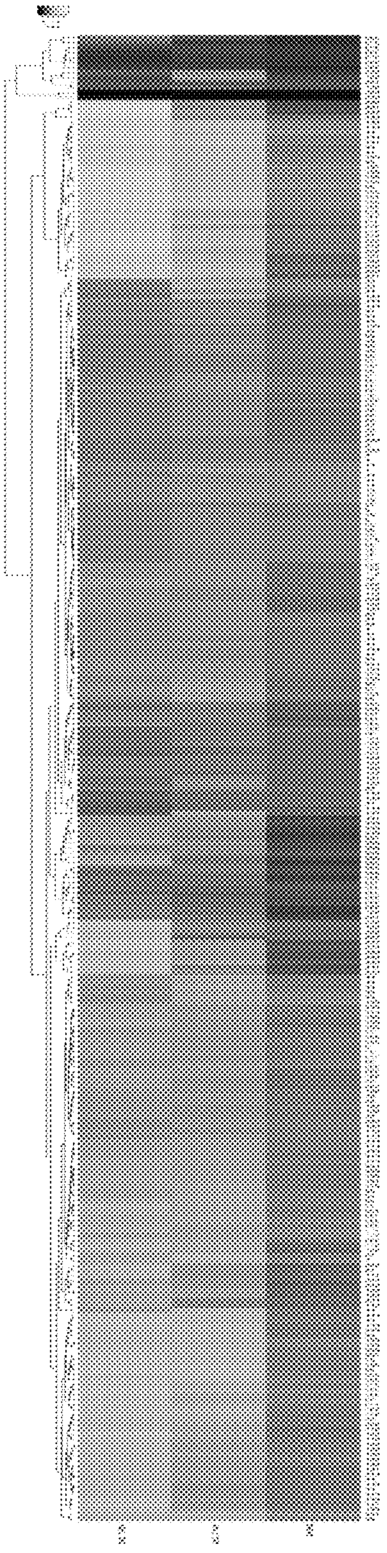
FIG. 4 shows a heatmap of prenylated products produced from Orf2 mutants when using O as substrate and GPP as donor.

The amount of each prenylation product was measured by HPLC. FIG. 4 shows a heatmap of the HPLC areas of each prenylation product generated using O as substrate and GPP as donor. Each column represents a single prenylation product and each row represents an Orf2 or Orf2 variant. Prenylation products are labeled by retention time. Enzyme variants are labeled by ID #as listed in Table 8.

Example 6: Generation of ORF2 Variants which Synthesize an Altered Amount of Prenylated Products when Using DVA as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position.

The wild type Orf2 prenylation reaction using DVA as substrate and GPP as donor produces 6 products as detected by HPLC. The respective retention times of these products are approximately 5.28, 6.39, 6.46, 7.31, 7.85, and 10.79 minutes.

Table 9A provides a summary of the prenylation products produced from DVA and GPP, their retention times, and the hypothesized prenylation site on DVA. FIG. 20 shows the predicted chemical structures of the respective prenylation products.

TABLE 9A

Predicted prenylation products of Orf2 or Orf2 Mutants when using DVA as substrate and GPP as donor

| Molecule ID | Substrate | Donor | Attachment Site | Retention Time |
|---|---|---|---|---|
| RBI-24 | DVA | GPP | CO | 5.28 |
| RBI-28 | DVA | GPP | 2-O | 7.847 |
| UNK11 | DVA | GPP | 4-O | 7.313 |
| RBI-26 | DVA | GPP | 3-C | 6.39 |
| RBI-27 | DVA | GPP | 5-C | 6.46 |
| RBI-29 | DVA | GPP | 3-C + 5-C | 10.187 |

Figure 80:
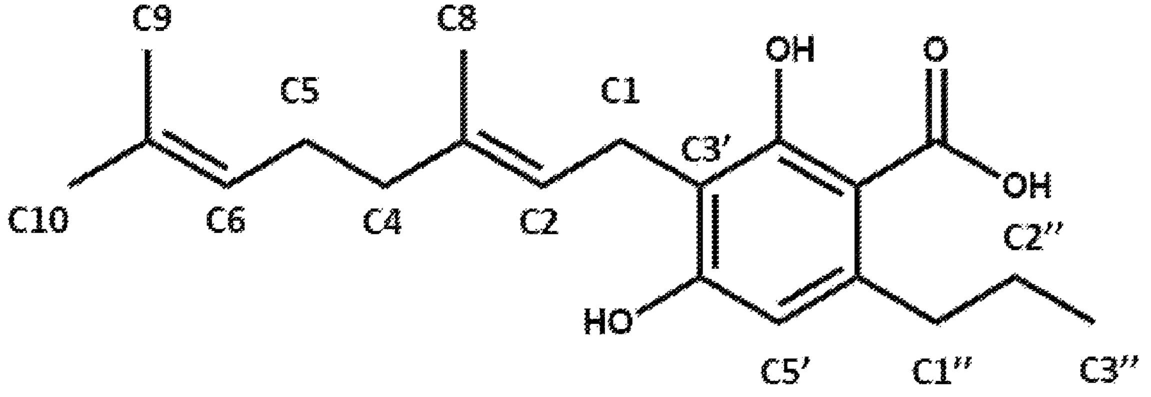
FIG. 80: Carbon and proton NMR assignments for CBGVA.

Tables 9B-9D provide NMR data of proton and carbon chemical shifts for CBGVA with (a) HSQC, (b) HMBC correlation and (c) final carbon and proton NMR assignments (the HMBC "Proton list" column in all NMR assignment tables displays protons which are J-Coupled to and within 1-4 carbons of the corresponding carbon in the row). The carbon and proton NMR assignments for CBGVA are shown in FIG. 80.

TABLE 9B

Proton NMR Assignments for CBGVA

| PROTON Shift | Area | Pro-tons | C Assignment | HSQC-DEPT | Options | Actual |
|---|---|---|---|---|---|---|
| 0.89 | 3.16 | 3 | C3" | .89-.91 | CH or CH3 | CH3 |
| 1.501 | 2.09 | 2 | C2" | 1.5 | CH2 | CH2 |
| 1.52 | 3.19 | 3 | C9 | 1.52 | CH or CH3 | CH3 |
| 1.587 | 2.9 | 3 | C10 | 1.59 | CH or CH3 | CH3 |
| 1.708 | 3.12 | 3 | C8 | 1.71 | CH or CH3 | CH3 |
| 1.897 | 2.08 | 2 | C4 | 1.89 | CH2 | CH2 |
| 1.989 | 2.08 | 2 | C5 | 2 | CH2 | CH2 |
| 2.755 | 1.9 | 2 | C1" | 2.75 | CH2 | CH2 |
| 3.183 | 1.97 | 2 | C1 | 3.19 | CH2 | CH2 |
| 5.03 | 1 | 1 | C6 | 5.03 | CH or CH3 | CH |
| 5.149 | 1.04 | 1 | C2 | 5.15 | CH or CH3 | CH |
| 6.24 | 0.955 | 1 | C5 | 6.24 | CH or CH3 | CH |
| 10.014 | 0.906 | 1 | 4'OH? | X | X | X |
| 12.597 | 0.879 | 1 | 2'OH? | X | X | X |
| 13.518 | 0.859 | 1 | COOH? | X | X | X |
| | H Sum: | 28 | | | | |

TABLE 9C

Carbon NMR Assignments for CBGVA

| CARBON Shift | Assignment | Carbon ct. | NMR Predictions |
|---|---|---|---|
| 14.62 | C3" | 1 | 13.7 |
| 16.37 | C8 | 1 | 16.4 |
| 17.98 | C9 | 1 | 18.6 |
| 22.01 | C1 | 1 | 21.9 |
| 25.09 | C2" | 1 | 24.1 |
| 25.91 | C10 | 1 | 24.6 |
| 26.63 | C5 | 1 | 26.4 |
| 38.35 | C1" | 1 | 38.7 |
| 39.77 | C4 | 1 | 39.7 |
| 103.58 | C1' | 1 | 109.6 |
| 110.37 | C5' | 1 | 111.9 |
| 112.65 | C3' | 1 | 113.4 |
| 123.04 | C2 | 1 | 122.3 |
| 124.58 | C6 | 1 | 123.5 |
| 131.06 | C7 | 1 | 132 |
| 134.01 | C3 | 1 | 136.5 |
| 144.87 | C6' | 1 | 145.6 |
| 160.03 | C2' | 1 | 160.1 |
| 163.27 | C4' | 1 | 161.4 |
| 174.4 | COOH | 1 | 175.9 |
| | C Sum: | 20 | |

TABLE 9D

HMBC for sample CBGVA

| 1D C C Shift | Assignment | Associated Proton Shifts | | | | Proton List | | |
|---|---|---|---|---|---|---|---|---|
| 14.62 | C3" | 0.98 | 0.77 | 1.49 | 2.74 | C3" | C2" | C1" |
| 16.37 | C8 | 5.14 | | | | C2 | | |
| 17.98 | C9 | 1.41 | 1.58 | 1.61 | | C9 | C10 | C8 |
| 22.01 | C1 | X | | | | | | |
| 25.09 | C2" | 0.88 | 2.74 | | | C3" | C1" | |

TABLE 9D-continued

HMBC for sample CBGVA

| 1D C C Shift | Assignment | Associated Proton Shifts | | | Proton List | | |
|---|---|---|---|---|---|---|---|
| 25.91 | C10 | 1.47 | | | C9 | | |
| 26.63 | C5 | X | | | | | |
| 38.35 | C1" | 0.88 | 6.23 | 1.48 | C3" | C2" | C5' |
| 39.77 | C4 | 5.14 | 1.7 | | C8 | C2 | |
| 103.58 | C1' | 6.24 | 2.73 | | C1" | C5' | |
| 110.37 | C5' | 2.75 | 2.74 | | C1" | | |
| 112.65 | C3' | 3.17 | 6.23 | 10.01 | C1 | C5' | 4'OH? |
| 123.04 | C2 | 1.7 | 3.17 | 1.88 | C8 | C4 | C1 |
| 124.58 | C6 | 1.9 | | | C5 | | |
| 131.06 | C7 | 1.99 | 1.58 | 1.51 | C9 | C10 | C5 |
| 134.01 | C3 | 3.17 | | | C1 | | |
| 144.87 | C6' | 2.75 | | | C1" | | |
| 160.03 | C2' | 6.23 | 10.01 | 3.17 | C1 | C5' | 4'OH? |
| 163.27 | C4' | 3.17 | 3.17 | | C1 | | |
| 174.4 | COOH | X | | | | | |

Figure 81:
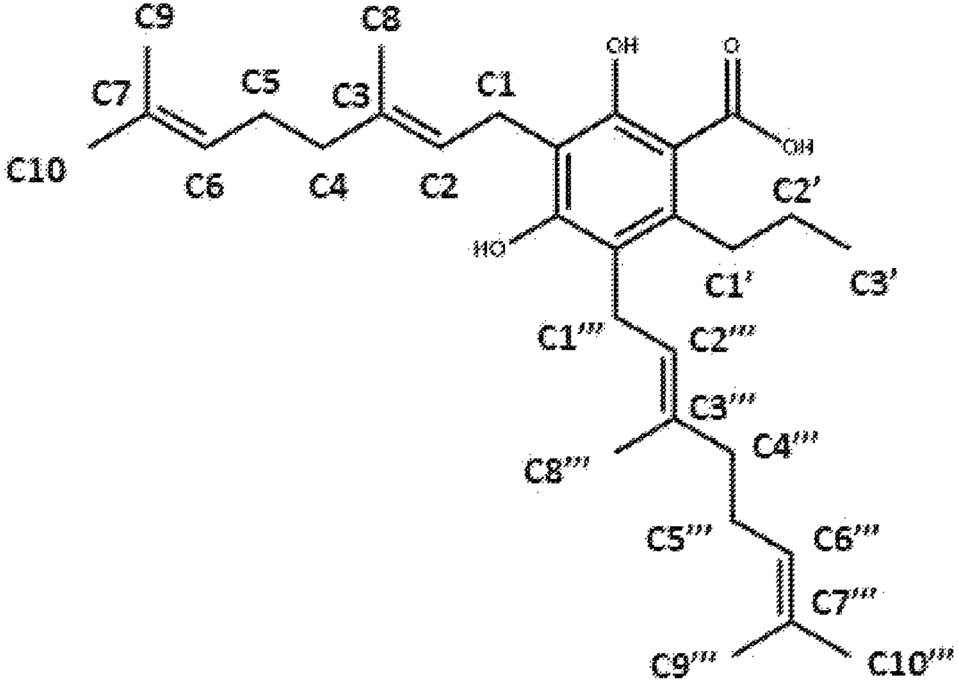
FIG. 81: Carbon and proton NMR assignments for RBI-29.

Tables 9E-9G provide NMR data of proton and carbon chemical shifts for RBI-29 with (a) HSQC, (b) HMBC correlation and (c) final carbon and proton NMR assignments. The carbon and proton NMR assignments for RBI-29 are shown in FIG. 81.

TABLE 9E

Proton NMR assignments for RBI-29.

| PROTON Shift | Area | Pro-tons | C Assignment | HSQC-DEPT | MULTIPLICITY Options | Actual |
|---|---|---|---|---|---|---|
| 0.926 | 3.16 | 3 | C3" | 0.91 | CH or CH3 | CH3 |
| 1.455 | 2.23 | 2 | C2" | 1.44 | CH2 | CH2 |
| 1.521 | 3.19 | 3 | C9 | 1.51 | CH or CH3 | CH3 |
| 1.535 | 3.19 | 3 | C9" | 1.51 | CH or CH3 | CH3 |
| 1.587 | 3.11 | 3 | C10 | 1.58 | CH or CH3 | CH3 |
| 1.602 | 3.16 | 3 | C10'" | 1.58 | CH or CH3 | CH3 |
| 1.717 | 6.13 | 6 | C8 + C8'" | 1.7 | CH or CH3 | CH3 |
| 1.904 | 2.21 | 2 | C4'" | 1.89 | CH2 | CH2 |
| 1.941 | 2.06 | 2 | C4 | 1.94 | CH2 | CH2 |
| 2.007 | 4.25 | 4 | C5 + C5'" | 2 | CH2 | CH2 |
| 2.752 | 1.99 | 2 | C1" | 2.74 | CH2 | CH2 |
| 3.283 | 4.09 | 4 | C1 + C1'" | 3.26-3.28 | CH2 | CH2 |
| 4.953 | 1 | 1 | C6'" | 4.94 | CH or CH3 | CH |
| 5.034 | 2.11 | 2 | C6 + C2'" | 5.02 | CH or CH3 | CH |
| 5.1 | 1.09 | 1 | C2 | 5.1 | CH or CH3 | CH |
| 8.829 | 1.06 | 1 | 4' OH? | X | X | X |
| 12.027 | 0.829 | 1 | 2' OH? | X | X | X |
| 13.508 | 0.779 | 1 | COOH? | X | X | X |
| | H Sum: | 44 | | | | |

TABLE 9F

Carbon NMR assignments for RBI-29.

| CARBON Shift | Assignment | Carbon ct. | NMR Predictions |
|---|---|---|---|
| 15.23 | C3" | 1 | 13.7 |
| 16.48 | C8 | 1 | 16.4 |
| 16.38 | C8'" | 1 | 16.4 |
| 17.97 | C9 | 1 | 18.6 |
| 17.99 | C9'" | 1 | 18.6 |
| 22.52 | C1 | 1 | 22.2 |
| 24.8 | C2" | 1 | 24.4 |
| 25.1 | C1'" | 1 | 25.1 |
| 25.91 | C10 | 1 | 24.6 |
| 25.94 | C10'" | 1 | 24.6 |
| 26.53 | C5 | 1 | 26.4 |
| 26.62 | C5'" | 1 | 26.4 |
| 32.95 | C1" | 1 | 33.6 |

TABLE 9F-continued

Carbon NMR assignments for RBI-29.

| CARBON Shift | Assignment | Carbon ct. | NMR Predictions |
|---|---|---|---|
| 39.66 | C4''' | 1 | 39.7 |
| 39.77 | C4 | 1 | 39.7 |
| 106.12 | C1' | 1 | 106.3 |
| 113.63 | C3' | 1 | 113.3 |
| 123.11 | C2 | 1 | 122.3 |
| 120.12 | C2''' | 1 | 122.3 |
| 124.53 | C6 | 1 | 123.5 |
| 124.58 | C6''' | 1 | 123.5 |
| 124.61 | C5' | 1 | 125.1 |
| 131.08 | C7''' + C7? | 2 | 132 |
| 133.64 | C3 | 1 | 136.5 |
| 134.26 | C3''' | 1 | 136.5 |
| 142.07 | C6' | 1 | 140.7 |
| 157.69 | C2' | 1 | 157.1 |
| 159.94 | C4' | 1 | 158.5 |
| 174.3 | COOH | 1 | 173.2 |
| | CSUM: | 30 | |

TABLE 9G

HMBC for sample RBI-29.

| 1D C C Shift | Assignment | Associated Proton Shifts | | | | Proton List | | | |
|---|---|---|---|---|---|---|---|---|---|
| 15.23 | C3'' | 2.76 | 0.82 | 1.03 | 1.45 | C3'' | C2'' | C1'' | |
| 16.38 | C8''' | 4.95 | 1.61 | | | C6''' | C10''' | | |
| 16.48 | C8 | 5.1 | | | | C2 | | | |
| 17.97 | C9 | 5.03 | | | | C6 + C2''' | | | |
| 17.99 | C9''' | 5.03 | | | | C6 + C2''' | | | |
| 24.8 | C2'' | 2.77 | 0.93 | 2.74 | | C3'' | C1'' | | |
| 25.91 | C10 | 5.04 | | | | C6 + C2''' | | | |
| 25.94 | C10''' | 5.04 | | | | C6 + C2''' | | | |
| 26.53 | C5 | 1.94 | | | | C4 | | | |
| 32.95 | C1'' | 1.45 | 0.92 | | | C3'' | C2'' | | |
| 39.66 | C4''' | 2.02 | 4.95 | 1.72 | | C8''' | C5''' | C6''' | |
| 39.77 | C4 | 5.1 | | | | C2 | | | |
| 106.12 | C1' | 2.76 | 2.76 | 2.74 | | C1'' | | | |
| 113.63 | C3' | 8.83 | 3.29 | | | C1 + C1''' | 4' OH | | |
| 120.12 | C2''' | 2.77 | 3.27 | 8.83 | 4.96 | C1'' | C1''' | C6''' | 4' OH |
| 123.11 | C2 | 3.29 | 1.91 | 1.72 | | C8 | C4 | C1 | |
| 124.58 | C6''' | 1.6 | | | | C10''' | | | |
| 124.61 | C6' | 3.27 | | | | C1 + C1''' | | | |
| 131.05 | C7 | 2.02 | | | | C5 + C5''' | | | |
| 131.07 | C7''' | 1.53 | | | | C9''' | | | |
| 133.64 | C3 | 3.27 | | | | C1 | | | |
| 134.26 | C3''' | 1.91 | 1.99 | | | C4''' | C5''' | | |
| 142.07 | C6' | 2.77 | 3.27 | | | C1'' | C1 + C1''' | | |
| 157.69 | C2' | 8.83 | 3.29 | | | 4' OH | C1 + C1''' | | |
| 159.94 | C4' | 3.29 | | | | C1 + C1''' | | | |
| 174.3 | COOH | X | | | | | | | |

Table 10 provides a summary of the analysis performed on the enzymatic activity of the ORF2 variants to produce prenylated products using DVA as substrate and GPP as donor. Table 10 lists the mutations within each of the mutants analyzed as well mAU*min areas from the HPLC analysis of the reaction products.

TABLE 10

HPLC Area in mAU*min of preny1ation products produced by Orf2 and Orf2 Variants when using DVA as substrate and GPP as donor

| ID# | Mutations | 5.28 | RBI-26 (6.39) | RBI-27 (6.46) | 7.313 | 7.847 | 10.187 |
|---|---|---|---|---|---|---|---|
| 1 | V9_Q38G_E112D_F123H | 0.0116 | 0.2029 | 0.2594 | 0.0497 | 0.1237 | 0.0647 |
| 2 | V17_V49L_F123A_Y283L | 0.0157 | 0.1418 | 2.4804 | 0.1067 | 0.0802 | 0.0894 |
| 3 | V17_V49L_F123A_Y283L | 0.0139 | 0.2044 | 0.2668 | 0.0436 | 0.1284 | 0.1542 |
| 4 | V25_L219F_V294N_Q295A | 0.0601 | 1.6865 | 13.135 | 0.1194 | 0.2705 | 1.6922 |
| 5 | V33_A17T_C25V_E112G | 0.1202 | 1.6759 | 26.2413 | 0.1208 | 0.5823 | 1.1526 |
| 6 | V49_G205L_R228E_C230N | 0.0031 | 0.0047 | 0.4097 | 0.0818 | 0.014 | 0.0257 |
| 7 | V57_C25V_A232S_V271E | 0.0027 | 0.0414 | 0.1129 | 0.0885 | 0.0254 | 0.0108 |
| 8 | V65_V49A_Q161S_V294A | 0.3155 | 34.3128 | 9.7853 | 0.2417 | 1.1597 | 1.8023 |
| 9 | V73_V49S_K118Q_S177E | 4.4335 | 2.102 | 3.771 | 0.127 | 2.0094 | 0.6548 |
| 10 | V81_V49L_D166E_L274V | 0.0166 | 0.0117 | 0.0741 | 0.0819 | 0.0083 | 0.003 |

TABLE 10-continued

| HPLC Area in mAU*min of preny1ation products produced by Orf2 and Orf2 Variants when using DVA as substrate and GPP as donor | | | | | | | |
|---|---|---|---|---|---|---|---|
| ID# | Mutations | 5.28 | RBI-26 (6.39) | RBI-27 (6.46) | 7.313 | 7.847 | 10.187 |
| 11 | V89_Y121W_S177Y_G286E | 0.0024 | 0.0012 | 0.1278 | 0.088 | 0.0215 | 0.0022 |
| 12 | V10_V49A_S177Y_C209G | 0.0002 | 0.0028 | 0.1592 | 0.0895 | 0.0462 | 0.0007 |
| 13 | V26_A53E_A108G_K118N | 0.0058 | 0.0096 | 0.1707 | 0.0999 | 0.0253 | 0.0008 |
| 14 | V34_A53Q_Y121W_A232S | 0.0016 | 0.0036 | 0.1282 | 0.1032 | 0.0234 | 0.0009 |
| 15 | V42_D166E_S177Y_S214F | 0.0014 | 0.0036 | 0.1247 | 0.1017 | 0.0526 | 0.0006 |
| 16 | V58_K118Q_L174V_R228Q | 0.0153 | 0.1069 | 2.2884 | 0.0987 | 0.0628 | 0.0304 |
| 17 | V66_C25V_F213M_Y216A | 0.033 | 0.4296 | 1.2759 | 0.0878 | 0.11 | 0.0223 |
| 18 | V74_M106E_Y121W_D166E | 0.0024 | 0.0021 | 0.1125 | 0.1051 | 0.0206 | 0.001 |
| 19 | V82_V49S_K119D_F213M | 0.002 | 0.002 | 0.1162 | 0.0957 | 0.017 | 0.0005 |
| 20 | V3_V49S_M162A_Y283L | 0.0439 | 0.3596 | 5.6085 | 0.0991 | 0.4092 | 0.2363 |
| 21 | V11_K118N_K119A_V271E | 0.0016 | 0.0003 | 0.0757 | 0.0918 | 0.0114 | 0.0005 |
| 22 | V19_V49L_S214R_V271E | 0.0091 | 0.0042 | 0.1222 | 0.0938 | 0.0161 | 0.0017 |
| 23 | V35_A53Q_S177Y_Y288H | 0.4867 | 7.087 | 1.851 | 0.1799 | 0.6778 | 0.1085 |
| 24 | V43_Q161A_M162F_Q295A | 0.0469 | 1.9058 | 3.0942 | 0.1386 | 0.1927 | 0.3506 |
| 25 | V51_V49L_K119D_G205M | 0.0049 | 0.0065 | 0.1274 | 0.0986 | 0.0177 | 0.0004 |
| 26 | V59_V49S_S214G_V294A | 1.346 | 1.4137 | 3.1464 | 0.1286 | 0.4483 | 0.1492 |
| 27 | V67_A108G_K119D_L298A | 0.0087 | 0.0009 | 0.1421 | 0.1074 | 0.0245 | 0.0012 |
| 28 | V75_A53Q_L274V_Q295A | 0.0017 | 0.0095 | 0.7593 | 0.1047 | 0.0231 | 0.0106 |
| 29 | V83_E112D_L219F_V294F | 0.1046 | 1.9929 | 22.6533 | 0.1317 | 0.4242 | 1.5442 |
| 30 | V91_N173D_F213M_V294F | 0.0221 | 0.2818 | 24.9336 | 0.0941 | 0.2283 | 0.7472 |
| 31 | V4_K118Q_Q161W_S214F | 0.0034 | 0.0183 | 1.8559 | 0.0908 | 0.0238 | 0.032 |
| 32 | V20_D227E_C230N_Q295W | 0.0447 | 0.2064 | 0.1871 | 0.0993 | 0.0301 | 0.0041 |
| 33 | V28_A53T_D166E_Q295W | 0.8331 | 5.0092 | 9.989 | 0.1365 | 0.4405 | 2.8021 |
| 34 | V44_A53E_Q161A_V294N | 0.0638 | 2.7024 | 12.5126 | 0.1655 | 0.2401 | 0.8576 |
| 35 | V52_K119A_S214G_L298A | 0.0438 | 0.3317 | 3.2222 | 0.0437 | 0.1041 | 0.1821 |
| 36 | V60_E112D_K119A_N173D | 0.002 | 0.0247 | 0.2694 | 0.0334 | 0.0163 | 0.07 |
| 37 | V68_K118N_C209G_R228Q | 0.0015 | 0.0619 | 0.0619 | 0.034 | 0.018 | 0.0329 |
| 38 | V76_V49A_F123A_Y288H | 0.0046 | 0.0409 | 0.0409 | 0.0308 | 0.0134 | 0.0077 |
| 39 | V84_F123H_L174V_S177E | 0.0692 | 0.5558 | 1.707 | 0.0307 | 0.0562 | 0.0889 |
| 40 | V92_A53T_E112D_G205M | 0.152 | 1.4182 | 46.3544 | 0.0583 | 0.3993 | 4.3169 |
| 41 | V36_F123H_L274V_L298A | 0.0113 | 0.0259 | 0.3661 | 0.0936 | 0.0279 | 0.0265 |
| 42 | V69_A53T_M106E_Q161S | 0.7098 | 7.8315 | 28.6444 | 0.08 | 1.0245 | 7.7325 |
| 43 | V60_E112D_K119A_N173D | 0.0118 | 0.1075 | 0.6999 | 0.0245 | 0.0269 | 0.2583 |
| 44 | V62_A53T_N173D_S214R | 0.1673 | 6.4563 | 6.4563 | 0.1349 | 0.1015 | 0.4075 |
| 45 | V70_Q38G_D166E_Q295A | 0.0959 | 0.7644 | 2.0051 | 0.0329 | 0.0894 | 0.2967 |
| 46 | V78_K119D_Q161W_L298Q | 0.0062 | 0.0157 | 0.1319 | 0.0299 | 0.0207 | 0.0362 |
| 47 | V94_A17T_V49A_C230N | 0.0076 | 0.0678 | 0.3399 | 0.038 | 0.0262 | 0.0205 |
| 48 | V15_A53E_F213M_R228Q | 0.0175 | 0.1647 | 12.1818 | 0.041 | 0.0742 | 0.0908 |
| 49 | V23_L219F_Y283L_L298W | 0.0107 | 0.3286 | 5.095 | 0.0347 | 0.0381 | 0.0508 |
| 50 | V31_D227E_R228E_L298Q | 0.0009 | 0.166 | 2.0097 | 0.0405 | 0.0338 | 0.0061 |
| 51 | V39_A53T_K118N_S214F | 0.0071 | 0.83 | 3.0304 | 0.0318 | 0.0326 | 0.0108 |
| 52 | V47_K118Q_F123A_R228E | 0.0079 | 0.0085 | 0.1104 | 0.0303 | 0.0387 | 0.0004 |
| 53 | V55_V49S_Y216A_V294N | 0.3685 | 2.3208 | 0.5932 | 0.0451 | 0.1893 | 0.2569 |
| 54 | V63_F123W_M162F_C209G | 0.0044 | 0.0131 | 0.0645 | 0.025 | 0.0185 | 0.0017 |
| 55 | V63_F123W_M162F_C209G | 0.0118 | 0.0046 | 0.1423 | 0.1068 | 0.0469 | 0.045 |
| 56 | V71_M106E_G205L_C209G | 0.006 | 0.0101 | 0.045 | 0.033 | 0.0215 | 0.0006 |
| 57 | V79_V49A_Y121W_C230S | 0.0073 | 0.0103 | 0.0448 | 0.0264 | 0.0218 | 0.0002 |
| 58 | V87_S177W_Y288H_V294N | 0.0074 | 0.0245 | 0.0336 | 0.0273 | 0.0197 | 0.0007 |
| 59 | V95_A17T_Q161W_A232S | 0.1967 | 39.9177 | 7.2044 | 0.0955 | 0.561 | 0.2573 |
| 60 | V8_K119A_Q161A_R228Q | 0.0055 | 0.3249 | 0.2954 | 0.0283 | 0.0291 | 0.0012 |
| 61 | V16_A53Q_S177W_L219F | 0.0805 | 8.2799 | 8.4137 | 0.0381 | 0.2414 | 2.9411 |
| 62 | V24_A17T_F213M_S214R | 0.2644 | 10.6799 | 1.9755 | 0.2939 | 0.2397 | 1.415 |
| 63 | V32_M162A_C209G_Y288H | 0.0022 | 0.008 | 0.0584 | 0.0283 | 0.0258 | 0.1209 |
| 64 | V40_S177E_S214R_R228E | 0.0105 | 0.0159 | 0.0344 | 0.0318 | 0.0221 | 0.0589 |
| 65 | V48_V49L_E112D_G286E | 0.0009 | 0.0161 | 0.0279 | 0.0318 | 0.1506 | 0.0259 |
| 66 | V56_F123A_M162F_S214G | 0.0134 | 0.0183 | 0.1865 | 0.0372 | 0.0267 | 0.0181 |
| 67 | V64_M106E_M162A_Y216A | 0.0099 | 1.9865 | 0.9067 | 0.0439 | 0.0528 | 0.11 |
| 68 | V72_E112G_G205M_L298W | 0.0478 | 0.8602 | 15.2104 | 0.0331 | 0.1345 | 0.3888 |
| 69 | V80_M162A_N173D_S214F | 0.0085 | 1.1313 | 4.8355 | 0.0179 | 0.0224 | 0.0462 |
| 70 | V88_A108G_Q161S_G205M | 0.404 | 5.3223 | 9.3605 | 0.1202 | 0.5826 | 4.5881 |
| 71 | WT | 0.1534 | 3.2939 | 25.5522 | 0.143 | 0.4528 | 4.6432 |
| 72 | Q38G_D166E | 0.0531 | 0.967 | 8.8512 | 0.0324 | 0.1771 | 0.2033 |
| 73 | Q38G_Q295A | 0.1662 | 3.8883 | 26.6189 | 0.0642 | 0.403 | 2.4124 |
| 74 | D166E_Q295A | 0.0571 | 1.1776 | 8.5988 | 0.0486 | 0.1606 | 0.5462 |
| 75 | L219F_V294N | 0.1025 | 3.3033 | 32.2708 | 0.0772 | 0.3164 | 2.1744 |
| 76 | L219F_Q295A | 0.0501 | 1.3315 | 8.1492 | 0.0456 | 0.1575 | 0.7358 |
| 77 | V294N_Q295A | 0.1248 | 4.0841 | 38.653 | 0.0985 | 0.4325 | 3.184 |
| 78 | A53Q_S177W | 0.071 | 8.75 | 8.2973 | 0.0366 | 0.2612 | 2.996 |
| 79 | A53Q_L219F | 0.1107 | 2.4675 | 30.8418 | 0.0499 | 0.3968 | 2.6169 |
| 80 | S177W_L219F | 0.0623 | 6.3564 | 5.7238 | 0.0375 | 0.2132 | 0.7634 |
| 81 | A108G_Q161S | 0.3131 | 5.0592 | 10.7488 | 0.1281 | 0.5627 | 2.8129 |
| 82 | A108G_G205M | 0.0726 | 0.7464 | 5.3991 | 0.0368 | 0.143 | 0.1928 |
| 83 | Q161S_G205M | 0.314 | 10.5475 | 26.7975 | 0.1626 | 0.6334 | 3.1132 |
| 84 | F123H_L174V | 0.0256 | 0.1954 | 1.872 | 0.0335 | 0.0404 | 0.1361 |

TABLE 10-continued

HPLC Area in mAU*min of preny1ation products produced by Orf2 and Orf2 Variants when using DVA as substrate and GPP as donor

| ID# | Mutations | 5.28 | RBI-26 (6.39) | RBI-27 (6.46) | 7.313 | 7.847 | 10.187 |
|---|---|---|---|---|---|---|---|
| 85 | F123H_S177E | 0.0978 | 0.634 | 2.0459 | 0.027 | 0.0731 | 0.1378 |
| 86 | L174V_S177E | 1.0119 | 23.9032 | 6.0703 | 0.1476 | 0.5944 | 1.0057 |
| 87 | A53T_D166E | 0.1264 | 1.2216 | 36.1931 | 0.0431 | 0.454 | 1.9745 |
| 88 | A53T_Q295W | 1.9159 | 13.8016 | 9.1083 | 0.0821 | 1.0984 | 14.3127 |
| 89 | D166E_Q295W | 0.5863 | 5.4552 | 4.8899 | 0.0814 | 0.2909 | 0.9001 |
| 90 | A53Q_S177Y | 0.0776 | 1.6255 | 12.1489 | 0.0345 | 0.3286 | 0.5968 |
| 91 | A53Q_Y288H | 1.0686 | 8.2035 | 2.5167 | 0.1246 | 1.1723 | 0.4187 |
| 92 | S177Y_Y288H | 0.2957 | 4.9997 | 0.9936 | 0.0474 | 0.3503 | 0.0887 |
| 93 | V49A_Q161S | 0.3787 | 30.2063 | 7.8094 | 0.1781 | 1.1448 | 1.372 |
| 94 | V49A_V294A | 0.2397 | 12.4846 | 7.9125 | 0.1001 | 0.6664 | 0.3137 |
| 95 | Q161S_V294A | 0.3123 | 16.8091 | 28.9812 | 0.1123 | 0.7715 | 9.659 |
| 96 | A53T_M106E | 0.4232 | 3.4372 | 28.2614 | 0.045 | 0.7028 | 2.1552 |
| 97 | A53T_Q161S | 0.3862 | 9.1042 | 29.1511 | 0.0457 | 0.611 | 6.006 |
| 98 | M106E_Q161S | 0.1518 | 3.3319 | 8.0635 | 0.0645 | 0.3214 | 0.5736 |
| 99 | A53T_K118N | 0.0959 | 0.712 | 16.7461 | 0.0318 | 0.3167 | 0.5034 |
| 100 | A53T_S214F | 0.0216 | 5.5146 | 18.8046 | 0.0328 | 0.0812 | 0.318 |
| 101 | A53T_S214F | 0.015 | 3.4108 | 10.2036 | 0.027 | 0.065 | 0.1592 |
| 102 | K118N_S214F | 0.0076 | 0.2044 | 0.3947 | 0.0339 | 0.0135 | 0.0195 |
| 103 | A108G | 0.045 | 0.5806 | 4.0899 | 0.0283 | 0.1501 | 0.172 |
| 104 | A53Q | 0.112 | 2.7407 | 33.1809 | 0.0494 | 0.4284 | 3.3236 |
| 105 | A53T | 0.2183 | 2.7698 | 45.2434 | 0.0583 | 0.6592 | 7.8943 |
| 106 | D166E | 0.1007 | 1.8957 | 19.0241 | 0.0375 | 0.3512 | 1.1227 |
| 107 | F123H | 0.0121 | 0.1307 | 1.4159 | 0.0235 | 0.0493 | 0.1171 |
| 108 | G205M | 0.1536 | 2.7465 | 26.3236 | 0.0674 | 0.5014 | 2.5218 |
| 109 | K118N | 0.0722 | 0.7924 | 5.849 | 0.036 | 0.2064 | 0.1193 |
| 110 | L219F | 0.1085 | 2.7357 | 19.9335 | 0.0515 | 0.3193 | 1.5967 |
| 111 | M106E | 0.0633 | 1.0405 | 3.9416 | 0.0237 | 0.1446 | 0.1373 |
| 112 | Q161S | 0.395 | 14.6696 | 21.3891 | 0.1376 | 0.6734 | 9.3316 |
| 113 | Q295A | 0.0969 | 2.7008 | 13.0209 | 0.0717 | 0.3548 | 2.7174 |
| 114 | Q295W | 0.7155 | 9.1763 | 3.9763 | 0.0596 | 0.3475 | 2.3076 |
| 115 | Q38G | 0.0984 | 2.0856 | 15.2255 | 0.0748 | 0.3309 | 1.076 |
| 116 | S177E | 1.1527 | 27.1399 | 5.6145 | 0.1559 | 0.5382 | 1.2392 |
| 117 | S177W | 0.0751 | 8.167 | 4.4896 | 0.033 | 0.2196 | 1.4872 |
| 118 | S177Y | 0.0624 | 1.3322 | 6.2469 | 0.0646 | 0.2523 | 0.2511 |
| 119 | S214F | 0.0045 | 1.0522 | 1.5619 | 0.0258 | 0.0143 | 0.0196 |
| 120 | V294A | 0.1405 | 4.4199 | 33.8137 | 0.1149 | 0.5394 | 6.0928 |
| 121 | V294N | 0.1121 | 3.429 | 31.862 | 0.1161 | 0.4903 | 4.3912 |
| 122 | V49A | 0.1905 | 6.5165 | 5.5114 | 0.0626 | 0.536 | 0.3822 |
| 123 | Y288H | 0.4036 | 4.1096 | 0.9622 | 0.1256 | 0.6521 | 0.1301 |
| 124 | WT | 0.1249 | 2.9334 | 25.2343 | 0.0646 | 0.3691 | 2.0163 |
| 125 | L174V | 0.1836 | 3.5358 | 22.2837 | 0.1427 | 0.4617 | 1.0333 |
| 126 | K118N | 0.1039 | 1.2611 | 8.1699 | 0.09 | 0.2522 | 0.1398 |
| 127 | K118Q | 0.0908 | 1.0934 | 27.4257 | 0.0867 | 0.3585 | 0.6408 |
| 128 | Q161W | 0.1011 | 0.6768 | 24.7827 | 0.0439 | 0.2526 | 0.3439 |
| 129 | D227E | 0.1421 | 2.6654 | 26.3001 | 0.1179 | 0.412 | 2.237 |
| 130 | L274V | 0.0397 | 1.0169 | 11.4671 | 0.1093 | 0.1642 | 0.385 |
| 131 | S214G | 0.7171 | 2.9071 | 14.6756 | 0.1489 | 0.9039 | 0.773 |
| 132 | Y216A | 0.144 | 0.9803 | 1.518 | 0.094 | 0.1158 | 0.0251 |
| 133 | F123W | 0.0094 | 0.0062 | 0.4912 | 0.0845 | 0.0258 | 0.0056 |
| 134 | V271E | 0.0129 | 0.0081 | 0.1683 | 0.0953 | 0.0335 | 0.0041 |
| 135 | N173D | 0.0347 | 0.6192 | 10.7673 | 0.0987 | 0.108 | 0.1021 |
| 136 | R228Q | 0.0471 | 0.7775 | 7.254 | 0.0904 | 0.1312 | 0.099 |
| 137 | M162F | 0.0819 | 2.1009 | 5.5282 | 0.1229 | 0.1237 | 1.8452 |
| 138 | A232S | 0.459 | 23.8334 | 8.9096 | 0.1803 | 1.3915 | 8.5504 |
| 139 | C230S | 0.1007 | 2.75 | 13.0536 | 0.1706 | 0.2211 | 1.0476 |
| 140 | K119Q | 0.0211 | 0.2784 | 5.2924 | 0.0804 | 0.0616 | 0.0512 |
| 141 | R228E | 0.0077 | 0.0623 | 0.2293 | 0.0883 | 0.1772 | 0.022 |
| 142 | V294F | 0.0812 | 1.7554 | 11.9659 | 0.1205 | 0.2965 | 0.614 |
| 143 | Y283L | 0.1071 | 2.7344 | 30.2377 | 0.1604 | 0.3776 | 0.9687 |
| 144 | S214R | 2.1392 | 53.1149 | 0.001 | 0.3194 | 0.3743 | 2.9412 |
| 145 | G286E | 0.0231 | 0.2041 | 0.7931 | 0.0914 | 0.0312 | 0.1842 |
| 146 | M162A | 0.0172 | 1.6258 | 23.0237 | 0.1002 | 0.329 | 0.7178 |
| 147 | Q161A | 0.1576 | 5.7143 | 17.0891 | 0.1445 | 0.5691 | 6.6368 |
| 148 | K119D | 0.1571 | 3.75 | 26.6466 | 0.1292 | 0.5189 | 6.1367 |
| 149 | G205L | 0.0559 | 1.2833 | 14.9855 | 0.1033 | 0.1442 | 0.542 |
| 150 | F123A | 0.0277 | 0.4359 | 2.4494 | 0.0963 | 0.3385 | 0.1685 |
| 151 | A53T_V294A | 0.1041 | 2.2627 | 34.0135 | 0.1159 | 0.5625 | 8.1547 |
| 152 | A53T_Q161S_V294A | 0.1718 | 5.7154 | 18.9083 | 0.0862 | 0.4181 | 5.9171 |
| 153 | A53T_Q161S_V294N | 0.1402 | 4.6934 | 17.5207 | 0.0946 | 0.4483 | 12.7291 |
| 154 | A53T_Q295A | 0.1197 | 1.7119 | 12.918 | 0.0969 | 0.549 | 11.3355 |
| 155 | Q161S_V294A_Q295A | 0.2124 | 11.5893 | 6.1801 | 0.1186 | 0.7545 | 20.6506 |
| 156 | A53T_Q161S_Q295A | 0.2399 | 6.9677 | 7.6228 | 0.0948 | 0.4729 | 4.3162 |
| 157 | A53T_V294A_Q295A | 0.1229 | 1.874 | 10.6083 | 0.0728 | 0.5437 | 10.7687 |
| 158 | A53T_Q161S_V294A_Q295A | 0.2802 | 8.3752 | 9.5435 | 0.1148 | 0.7828 | 28.0859 |

TABLE 10-continued

HPLC Area in mAU*min of preny1ation products produced by Orf2 and Orf2 Variants when using DVA as substrate and GPP as donor

| ID# | Mutations | 5.28 | RBI-26 (6.39) | RBI-27 (6.46) | 7.313 | 7.847 | 10.187 |
|---|---|---|---|---|---|---|---|
| 159 | A53T_Q161S_V294N_Q295A | 0.2565 | 7.7662 | 7.1111 | 0.1063 | 0.7522 | 34.9884 |
| 160 | A53T_Q295W | 1.6373 | 12.1532 | 7.1918 | 0.0977 | 1.1129 | 18.0539 |
| 161 | Q161S_V294A_Q295W | 0.3101 | 5.3676 | 3.451 | 0.0915 | 0.2333 | 1.1289 |
| 162 | A53T_Q161S_Q295W | 0.8058 | 10.4226 | 5.6942 | 0.0891 | 0.7716 | 9.9418 |
| 163 | A53T_V294A_Q295W | 1.8691 | 14.5967 | 8.5727 | 0.1099 | 1.1368 | 13.3037 |
| 164 | A53T_Q161S_V294A_Q295W | 1.1331 | 13.4626 | 11.7614 | 0.1854 | 0.7765 | 4.6893 |
| 165 | A53T_Q161S_V294N_Q295W | 0.7591 | 11.3653 | 13.5299 | 0.1746 | 0.7557 | 5.5845 |
| 166 | Q295A | 0.0655 | 2.0038 | 10.0405 | 0.1114 | 0.2956 | 2.1275 |
| 167 | Q295W | 1.065 | 11.8066 | 6.4685 | 0.1496 | 0.6682 | 4.8907 |
| 168 | Q295C | 0.0932 | 2.9121 | 9.6139 | 0.101 | 0.3937 | 4.292 |
| 169 | Q295E | 0.0207 | 1.7651 | 1.9432 | 0.0915 | 0.0506 | 0.2618 |
| 170 | Q295F | 1.3708 | 35.0794 | 1.1483 | 0.1637 | 2.5545 | 7.2897 |
| 171 | Q295G | 0.0519 | 1.8187 | 18.0005 | 0.1061 | 0.3483 | 6.4509 |
| 172 | Q295H | 0.4211 | 9.1506 | 19.1755 | 0.1779 | 0.5401 | 2.406 |
| 173 | Q295I | 0.2681 | 8.79 | 1.0036 | 0.0943 | 1.4647 | 0.4464 |
| 174 | Q295L | 0.2114 | 5.4162 | 4.0394 | 0.1077 | 1.0723 | 4.5794 |
| 175 | Q295M | 0.2618 | 8.7509 | 6.4515 | 0.1294 | 1.3546 | 11.8377 |
| 176 | Q295N | 0.0543 | 1.3219 | 20.4817 | 0.1028 | 0.4125 | 2.7856 |
| 177 | Q295P | 0.0724 | 1.4972 | 3.6145 | 0.0874 | 0.219 | 0.6531 |
| 178 | Q295R | 0.0043 | 0.1006 | 7.1948 | 0.0854 | 0.0554 | 0.1834 |
| 179 | Q295S | 0.0398 | 1.2416 | 15.8511 | 0.1131 | 0.248 | 1.1444 |
| 180 | Q295T | 0.0359 | 0.8869 | 5.8313 | 0.1032 | 0.1714 | 0.3931 |
| 181 | Q295V | 0.1485 | 1.9045 | 1.0598 | 0.037 | 0.7391 | 0.1365 |
| 182 | Q295D | 0.1064 | 3.3375 | 37.8092 | 0.1467 | 0.4666 | 1.3742 |
| 183 | Q295K | 0.0289 | 0.6459 | 10.0193 | 0.1022 | 0.1236 | 0.1361 |
| 184 | Q295Y | 0.15 | 3.8799 | 25.7461 | 0.1398 | 0.5447 | 1.0768 |
| 185 | S214D | 0.1248 | 4.8212 | 6.7036 | 0.2283 | 0.1557 | 0.824 |
| 186 | S214E | 0.1683 | 4.6655 | 1.5194 | 0.0982 | 0.2325 | 0.0637 |
| 187 | S214F | 0.0103 | 1.0741 | 1.4762 | 0.0999 | 0.0186 | 0.0194 |
| 188 | S214H | 0.3732 | 26.4158 | 0.001 | 0.239 | 0.3085 | 0.1902 |
| 189 | S214I | 0.0101 | 1.2463 | 1.409 | 0.1022 | 0.0197 | 0.0404 |
| 190 | S214K | 0.0846 | 4.8782 | 1.2723 | 0.0859 | 0.0344 | 0.1634 |
| 191 | S214L | 0.0083 | 0.14 | 0.0875 | 0.0713 | 0.0158 | 0.0247 |
| 192 | S214M | 0.0105 | 0.5869 | 0.4293 | 0.0776 | 0.0234 | 0.0243 |
| 193 | S214N | 0.973 | 4.2798 | 7.5619 | 0.1179 | 0.2841 | 0.0931 |
| 194 | S214R | 1.2573 | 34.1019 | 0.001 | 0.2668 | 0.2598 | 0.6229 |
| 195 | S214T | 0.133 | 3.5464 | 21.1803 | 0.1153 | 0.5028 | 1.2146 |
| 196 | S214V | 0.0875 | 2.2093 | 13.6844 | 0.0957 | 0.2688 | 0.6449 |
| 197 | S214W | 0.0088 | 0.0426 | 0.4008 | 0.0834 | 0.0188 | 0.0247 |
| 198 | S214Y | 0.0097 | 0.2006 | 0.2144 | 0.0762 | 0.0201 | 0.0209 |
| 199 | S214C | 0.0267 | 0.6854 | 21.995 | 0.1065 | 0.1374 | 0.3795 |
| 200 | S214G | 0.7307 | 3.0559 | 14.47 | 0.1147 | 0.622 | 0.622 |
| 201 | S214P | 0.0153 | 0.0393 | 1.1774 | 0.1058 | 0.0181 | 0.0233 |
| 202 | S214Q | 0.1706 | 3.5611 | 1.6229 | 0.0556 | 0.3723 | 0.3723 |
| 203 | Q161C | 0.0509 | 0.8844 | 43.2089 | 0.0634 | 0.4215 | 1.7517 |
| 204 | Q161F | 0.0837 | 10.0552 | 24.9092 | 0.0516 | 0.207 | 0.6356 |
| 205 | Q161I | 0.0759 | 1.2956 | 24.5569 | 0.0657 | 0.2488 | 1.1875 |
| 206 | Q161L | 0.0726 | 2.1623 | 26.0984 | 0.0651 | 0.2465 | 0.8572 |
| 207 | Q161L | 0.0631 | 1.8682 | 22.0069 | 0.0548 | 0.1889 | 0.8935 |
| 208 | Q161M | 0.1765 | 1.3606 | 41.9419 | 0.084 | 0.2606 | 0.4447 |
| 209 | Q161R | 0.1619 | 24.3846 | 3.7695 | 0.1052 | 0.2852 | 1.6835 |
| 210 | Q161S | 0.3461 | 12.437 | 19.8886 | 0.1486 | 0.4548 | 3.6143 |
| 211 | Q161T | 0.1657 | 6.9786 | 28.8877 | 0.1024 | 0.4342 | 4.0442 |
| 212 | Q161Y | 0.5964 | 21.0425 | 1.9789 | 0.1203 | 0.7872 | 12.6215 |
| 213 | Q161A | 0.1379 | 4.5896 | 19.6231 | 0.1788 | 0.4642 | 1.3495 |
| 214 | Q161D | 0.3729 | 3.1314 | 5.1056 | 0.0832 | 0.2034 | 0.2178 |
| 215 | Q161H | 0.8347 | 81.2454 | 0.001 | 0.3104 | 0.445 | 16.3332 |
| 216 | Q161G | 0.1213 | 2.5843 | 10.8548 | 0.1269 | 0.4907 | 0.4119 |
| 217 | Q161K | 0.1291 | 13.0135 | 2.8762 | 0.1408 | 0.222 | 3.5705 |
| 218 | Q161N | 0.202 | 2.5658 | 18.1028 | 0.1182 | 0.3937 | 1.678 |
| 219 | Q161P | 0.0658 | 2.0253 | 8.7803 | 0.0835 | 0.4269 | 0.4919 |
| 220 | Q161Q | 0.1189 | 3.3057 | 19.7637 | 0.1042 | 0.3368 | 1.5511 |
| 221 | Q161W | 0.0682 | 0.5008 | 17.8487 | 0.0535 | 0.2562 | 0.2668 |
| 222 | Q161E | 0.9022 | 4.3213 | 5.024 | 0.1677 | 0.1626 | 0.1626 |
| 223 | Q161V | 0.0896 | 1.536 | 13.4263 | 0.0714 | 0.3855 | 0.3855 |
| 224 | A53G | 0.1102 | 1.7457 | 13.7584 | 0.0992 | 0.322 | 0.1536 |
| 225 | A53D | 0.0652 | 1.2423 | 8.8984 | 0.0619 | 0.1081 | 0.3608 |
| 226 | A53E | 0.0073 | 0.0831 | 0.6345 | 0.0603 | 0.0119 | 0.0338 |
| 227 | A53K | 0.2531 | 3.2961 | 35.4059 | 0.073 | 0.6218 | 0.9172 |
| 228 | A53L | 0.153 | 5.5397 | 37.2614 | 0.1084 | 0.6553 | 1.6309 |
| 229 | A53Q | 0.126 | 2.7874 | 29.2018 | 0.0628 | 0.3578 | 0.9998 |
| 230 | A53Y | 0.099 | 1.2745 | 6.2225 | 0.0606 | 0.2013 | 0.0401 |
| 231 | A53F | 0.0288 | 1.2169 | 0.9987 | 0.0954 | 0.0365 | 0.0241 |
| 232 | A53H | 0.0219 | 0.4324 | 1.2156 | 0.1273 | 0.0624 | 0.0298 |

TABLE 10-continued

HPLC Area in mAU*min of preny1ation products produced by Orf2 and Orf2 Variants when using DVA as substrate and GPP as donor

| ID# | Mutations | 5.28 | RBI-26 (6.39) | RBI-27 (6.46) | 7.313 | 7.847 | 10.187 |
|---|---|---|---|---|---|---|---|
| 233 | A53I | 1.3589 | 7.3364 | 24.356 | 0.0701 | 2.5205 | 3.7819 |
| 234 | A53M | 0.1491 | 4.0903 | 33.0822 | 0.1398 | 0.5534 | 3.036 |
| 235 | A53N | 0.1752 | 1.396 | 18.8247 | 0.1036 | 0.3446 | 0.1973 |
| 236 | A53R | 0.1818 | 1.8241 | 20.7965 | 0.0455 | 0.5287 | 0.7574 |
| 237 | A53S | 0.1777 | 3.4592 | 30.3708 | 0.0809 | 0.477 | 1.8365 |
| 238 | A53T | 0.2181 | 2.7784 | 43.7465 | 0.0753 | 0.6791 | 6.1406 |
| 239 | A53V | 0.4721 | 6.5503 | 32.1044 | 0.1195 | 1.3511 | 1.936 |
| 240 | A53W | 0.0714 | 1.0017 | 20.3356 | 0.0499 | 0.283 | 0.7266 |
| 241 | A53C | 0.1836 | 4.5342 | 28.5658 | 0.1141 | 0.5567 | 0.5567 |
| 242 | A53P | 0.0069 | 0.0015 | 0.0887 | 0.086 | 0.0148 | 0.018 |
| 243 | S177W_Q295A | 0.2879 | 49.6105 | 0.001 | 0.1433 | 0.3429 | 0.4855 |
| 244 | S177W_S214R | 0.1756 | 8.898 | 0.001 | 0.2141 | 0.1526 | 0.0678 |
| 245 | Q161S_S177W | 0.1464 | 32.4331 | 2.5717 | 0.1568 | 0.399 | 1.061 |
| 246 | A53T_S177W | 0.2366 | 15.4625 | 8.8346 | 0.103 | 0.5306 | 2.9941 |
| 247 | V49A_Q295L | 0.1181 | 1.4388 | 1.2094 | 0.0596 | 0.281 | 0.0278 |
| 248 | V49A_S214R | 0.0702 | 3.7232 | 0.2083 | 0.1387 | 0.0551 | 0.0302 |
| 249 | A53T_Q295F | 2.8922 | 43.9523 | 2.8376 | 0.1994 | 3.5196 | 15.4435 |
| 250 | A53T_S214R | 2.2629 | 63.8414 | 0.001 | 0.2668 | 0.4 | 5.0836 |
| 251 | A53T_A161S | 0.4045 | 10.4118 | 26.798 | 0.2378 | 0.7315 | 15.9102 |
| 252 | Q161S_Q295F | 1.0875 | 46.2151 | 1.8605 | 0.2074 | 1.9207 | 3.6257 |
| 253 | Q161S_Q295L | 1.281 | 54.3225 | 1.5682 | 0.2466 | 2.4871 | 6.6647 |
| 254 | Q16S_S214R | 0.7657 | 29.2403 | 0.001 | 0.2615 | 0.2614 | 1.3356 |
| 255 | S214R_Q295F | 1.6437 | 35.9686 | 0.001 | 0.3189 | 0.2922 | 0.1282 |
| 256 | WT | 0.1334 | 2.8081 | 19.6766 | 0.0771 | 0.251 | 0.5108 |
| 257 | WT | 0.1817 | 3.9098 | 28.3319 | 0.0648 | 0.4219 | 5.6093 |
| 258 | WT | 0.156 | 3.609 | 29.5527 | 0.0726 | 0.4801 | 1.789 |
| 259 | WT | 0.1583 | 4.3295 | 30.5886 | 0.1363 | 0.6265 | 3.8492 |
| 260 | WT | 0.1405 | 3.4382 | 28.8822 | 0.142 | 0.4674 | 2.9774 |
| 261 | WT | 0.1464 | 4.0581 | 28.4161 | 0.1555 | 0.4595 | 0.8362 |
| 262 | WT | 0.1253 | 3.2069 | 22.7076 | 0.131 | 0.393 | 1.3584 |
| 263 | WT | 0.118 | 3.0373 | 20.2262 | 0.104 | 0.5182 | 4.06 |
| 264 | WT | 0.1345 | 3.7682 | 27.6547 | 0.0935 | 0.2818 | 0.2818 |
| 265 | Y288A | 1.026 | 13.8232 | 0.001 | 0.1892 | 0.6869 | 0.6869 |
| 266 | Y288C | 0.8557 | 17.3203 | 0.001 | 0.2429 | 0.6133 | 0.6133 |
| 267 | Y288D | 0.0498 | 0.9269 | 0.08 | 0.0898 | 0.1998 | 0.1998 |
| 268 | Y288E | 0.0304 | 0.361 | 0.0704 | 0.0691 | 0.0958 | 0.0958 |
| 269 | Y288F | 1.0675 | 86.6372 | 0.59 | 0.2631 | 0.346 | 0.346 |
| 270 | Y288G | 0.1955 | 13.5962 | 0.4393 | 0.2508 | 0.336 | 0.336 |
| 271 | Y288H | 0.3568 | 3.1893 | 0.827 | 0.139 | 0.298 | 0.298 |
| 272 | Y288I | 4.5539 | 64.9223 | 0.56 | 0.2809 | 0.4633 | 0.4633 |
| 273 | Y288K | 0.1383 | 2.2135 | 2.2135 | 0.1465 | 0.0263 | 0.0263 |
| 274 | Y288L | 5.7168 | 58.2768 | 1.3166 | 0.2538 | 0.916 | 0.916 |
| 275 | Y288M | 4.2171 | 55.2958 | 0.5908 | 0.2665 | 0.522 | 0.522 |
| 276 | Y288P | 1.4933 | 32.5754 | 0.2131 | 0.2457 | 0.9623 | 0.9623 |
| 277 | Y288R | 0.0204 | 0.4052 | 0.0521 | 0.0635 | 0.1646 | 0.1646 |
| 278 | Y288S | 0.2467 | 3.0757 | 0.1073 | 0.1676 | 0.3944 | 0.3944 |
| 279 | Y288T | 1.9406 | 25.6881 | 0.5724 | 0.2588 | 0.5747 | 0.5747 |
| 280 | Y288W | 0.1608 | 22.3033 | 0.616 | 0.2711 | 0.1796 | 0.1796 |
| 281 | A232S | 0.4997 | 25.0127 | 9.2312 | 0.1277 | 1.252 | 1.252 |
| 282 | N173D-S214R | 0.1009 | 3.6399 | 0.0187 | 0.1293 | 0.067 | 0.067 |
| 283 | N173D | 0.0255 | 0.898 | 7.2816 | 0.0873 | 0.0594 | 0.0594 |
| 284 | M162F | 0.0724 | 2.1125 | 5.0272 | 0.0838 | 0.0857 | 0.0857 |
| 285 | WT | 0.1586 | 4.6108 | 26.8708 | 0.1271 | 0.4956 | 0.4956 |
| 286 | A17T | 0.0646 | 2.1419 | 21.1073 | 0.1513 | 0.2712 | 0.2712 |
| 287 | A232S | 0.0548 | 2.0224 | 6.0788 | 0.12 | 0.1662 | 0.1662 |
| 288 | M162F-Q295A | 0.0449 | 2.123 | 1.8141 | 0.0849 | 0.1038 | 0.1038 |
| 289 | WT | 0.159 | 3.898 | 27.497 | 0.092 | 0.344 | 1.381 |
| 290 | A232S-1 | 0.357 | 24.056 | 13.24 | 0.169 | 1.074 | 6.912 |
| 291 | A232S-2 | 0.378 | 25.952 | 13.808 | 0.198 | 1.201 | 3.129 |
| 292 | S214A-1 | 0.365 | 0.638 | 21.548 | 0.06 | 0.199 | 0.145 |
| 293 | S214A-2 | 0.444 | 0.92 | 27.662 | 0.083 | 0.394 | 0.256 |
| 294 | S214Q-1 | 0.188 | 4.662 | 1.743 | 0.044 | 0.206 | 0.547 |
| 295 | S214Q-2 | 0.146 | 4.776 | 1.223 | 0.039 | 0.247 | 0.876 |
| 296 | Q161E-2 | 1.351 | 5.319 | 5.769 | 0.125 | 0.204 | 0.342 |
| 297 | Y288N | 0.186 | 2.309 | 0.246 | 0.087 | 0.208 | 0.032 |

Figure 5:
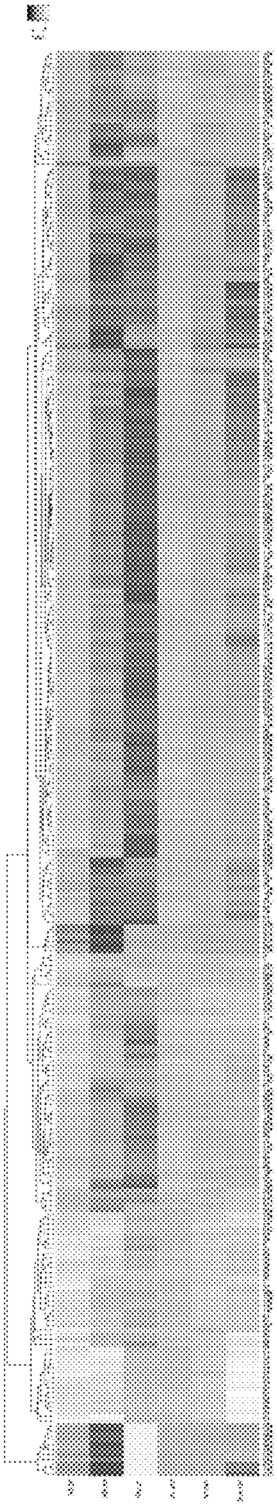
FIG. 5 shows a heatmap of prenylated products produced from Orf2 mutants when using DVA as substrate and GPP as donor

The amount of each prenylation product was measured by HPLC. FIG. 5 shows a heatmap of the HPLC areas of each prenylation product generated using DVA as substrate and GPP as donor. Each column represents a single prenylation product and each row represents an Orf2 or Orf2 variant. Prenylation products are labeled by retention time with the exception of RBI-26 and RBI-27. Enzyme variants are labeled by ID #as listed in Table 10.

Example 7: Generation of ORF2 Variants which Synthesize an Altered Amount of Prenylated Products when Using DVA as Substrate and FPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position.

The wild type Orf2 prenylation reaction using DVA as substrate and FPP as donor produces 5 products as detected by HPLC. The respective retention times of these products are approximately 7.05, 7.84, 8.03, 8.24, and 9.72 minutes.

Table 11 provides a summary of the prenylation products produced from DVA and FPP, their retention times, and the hypothesized prenylation site on DVA. FIG. 21 shows the predicted chemical structures of the respective prenylation products.

TABLE 11

Predicted prenylation products of Orf2 or Orf2 Mutants when using DVA as substrate and FPP as donor

| Molecule ID | Substrate | Donor | Attachment Site | Retention Time |
|---|---|---|---|---|
| UNK12 | DVA | FPP | CO | 7.05 |
| UNK13 | DVA | FPP | 2-O | 9.72 |
| UNK14 | DVA | FPP | 4-O | 8.24 |
| RBI-38 | DVA | FPP | 3-C | 7.84 |
| RBI-39 | DVA | FPP | 5-C | 8.03 |

Table 12 provides a summary of the analysis performed on the enzymatic activity of the ORF2 variants to produce prenylated products using DVA as substrate and FPP as donor. Table 12 lists the mutations within each of the mutants analyzed as well mAU*min areas from the HPLC analysis of the reaction products.

TABLE 12

HPLC Area in mAU*min of prenylation products produced by Orf2 and Orf2 Variants when using DVA as substrate and FPP as donor

| ID# | Mutations | 7.05 | 7.84 | 8.03 | 8.24 | 9.72 |
|---|---|---|---|---|---|---|
| 1 | V9_Q38G_E112D_F123H | 0.011 | 0.04 | 0.549 | 0.004 | 0.007 |
| 2 | V17_V49L_F123A_Y283L | 0.004 | 0.024 | 0.017 | 0.007 | 0.001 |
| 3 | V25_L219F_V294N_Q295A | 0.004 | 0.067 | 0.017 | 0.006 | 0.002 |
| 4 | V33_A17T_C25V_E112G | 0.015 | 0.06 | 0.121 | 0.006 | 0.006 |
| 5 | V57_C25V_A232S_V271E | 0.001 | 0.005 | 0.001 | 0.005 | 0.001 |
| 6 | V65_V49A_Q161S_V294A | 0.013 | 0.053 | 0.022 | 0.007 | 0.004 |
| 7 | V73_V49S_K118Q_S177E | 0.116 | 0.064 | 0.11 | 0.015 | 0.01 |
| 8 | V10_V49A_S177Y_C209G | 0.001 | 0.005 | 0.001 | 0.003 | 0.001 |
| 9 | V26_A53E_A1O8G_K118N | 0.001 | 0.001 | 0.001 | 0.005 | 0.001 |
| 10 | V34_A53Q_Y121W_A232S | 0.001 | 0.002 | 0.001 | 0.003 | 0.001 |
| 11 | V42_D166E_S177Y_S214F | 0.001 | 0.002 | 0.002 | 0.004 | 0.001 |
| 12 | V58_K118Q_L174V_R228Q | 0.001 | 0.002 | 0.002 | 0.003 | 0.001 |
| 13 | V66_C25V_F213M_Y216A | 0.001 | 0.003 | 0.001 | 0.004 | 0.001 |
| 14 | V74_M106E_Y121W_D166E | 0.001 | 0.002 | 0.001 | 0.004 | 0.001 |
| 15 | V82_V49S_K119D_F213M | 0.001 | 0.002 | 0.001 | 0.003 | 0.001 |
| 16 | V3_V49S_M162A_Y283L | 0.005 | 0.008 | 0.029 | 0.005 | 0.001 |
| 17 | V11_K118N_K119A_V271E | 0.001 | 0.002 | 0.001 | 0.003 | 0.001 |
| 18 | V19_V49L_S214R_V271E | 0.001 | 0.005 | 0.001 | 0.007 | 0.001 |
| 19 | V35_A53Q_S177Y_Y288H | 0.077 | 0.226 | 0.017 | 0.01 | 0.02 |
| 20 | V43_Q161A_M162F_Q295A | 0.004 | 0.076 | 0.016 | 0.005 | 0.001 |
| 21 | V51_V49L_K119D_G205M | 0.001 | 0.005 | 0.001 | 0.004 | 0.001 |
| 22 | V67_A108G_K119D_L298A | 0.001 | 0.006 | 0.001 | 0.003 | 0.001 |
| 23 | V83_E112D_L219F_V294F | 0.049 | 0.5 | 2.238 | 0.005 | 0.062 |
| 24 | V91_N173D_F213M_V294F | 0.001 | 0.028 | 0.049 | 0.003 | 0.001 |
| 25 | V4_K118Q_Q161W_S214F | 0.001 | 0.003 | 0.001 | 0.006 | 0.001 |
| 26 | V28_A53T_D166E_Q295W | 0.003 | 0.017 | 0.026 | 0.003 | 0.002 |
| 27 | V44_A53E_Q161A_V294N | 0.001 | 0.017 | 0.022 | 0.004 | 0.001 |
| 28 | V52_K119A_S214G_L298A | 0.001 | 0.008 | 0.001 | 0.005 | 0.001 |
| 29 | V60_E112D_K119A_N173D | 0.001 | 0.001 | 0.001 | 0.004 | 0.001 |
| 30 | V68_K118N_C209G_R228Q | 0.001 | 0.002 | 0.001 | 0.005 | 0.001 |
| 31 | V84_F123H_L174V_S177E | 0.02 | 0.051 | 0.157 | 0.005 | 0.001 |
| 32 | V92_A53T_E112D_G205M | 0.079 | 0.254 | 1.181 | 0.012 | 0.019 |
| 33 | V36_F123H_L274V_L298A | 0.0012 | 0.001 | 0.0007 | 0.0022 | 0.0003 |
| 34 | V69_A53T_M106E_Q161S | 0.013 | 0.027 | 0.493 | 0.006 | 0.006 |
| 35 | V60_E112D_K119A_N173D | 0.001 | 0.003 | 0.003 | 0.004 | 0.001 |
| 36 | V62_A53T_N173D_S214R | 0.001 | 0.025 | 0.002 | 0.003 | 0.001 |
| 37 | V70_Q38G_D166E_Q295A | 0.031 | 0.076 | 0.208 | 0.003 | 0.001 |

TABLE 12-continued

HPLC Area in mAU*min of prenylation products produced by Orf2 and Orf2 Variants when using DVA as substrate and FPP as donor

| ID# | Mutations | 7.05 | 7.84 | 8.03 | 8.24 | 9.72 |
|---|---|---|---|---|---|---|
| 38 | V78_K119D_Q161W_L298Q | 0.001 | 0.004 | 0.005 | 0.002 | 0.001 |
| 39 | V94_A17T_V49A_C230N | 0.001 | 0.002 | 0.001 | 0.004 | 0.001 |
| 40 | V15_A53E_F213M_R228Q | 0.001 | 0.006 | 0.02 | 0.003 | 0.001 |
| 41 | V23_L219F_Y283L_L298W | 0.001 | 0.012 | 0.027 | 0.004 | 0.001 |
| 42 | V31_D227E_R228E_L298Q | 0.001 | 0.002 | 0.001 | 0.003 | 0.001 |
| 43 | V39_A53T_K118N_S214F | 0.001 | 0.015 | 0.001 | 0.004 | 0.001 |
| 44 | V47_K118Q_F123A_R228E | 0.001 | 0.003 | 0.002 | 0.003 | 0.001 |
| 45 | V55_V49S_Y216A_V294N | 0.002 | 0.007 | 0.001 | 0.003 | 0.001 |
| 46 | V63_F123W_M162F_C209G | 0.001 | 0.002 | 0.001 | 0.002 | 0.001 |
| 47 | V71_M106E_G205L_C209G | 0.0002 | 0.0035 | 0.0001 | 0.0049 | 0.0003 |
| 48 | V79_V49A_Y121W_C230S | 0.001 | 0.002 | 0.001 | 0.002 | 0.001 |
| 49 | V87_S177W_Y288H_V294N | 0.001 | 0.001 | 0.001 | 0.003 | 0.001 |
| 50 | V95_A17T_Q161W_A232S | 0.007 | 0.083 | 0.065 | 0.007 | 0.005 |
| 51 | V8_K119A_Q161A_R228Q | 0.001 | 0.004 | 0.001 | 0.004 | 0.001 |
| 52 | V16_A53Q_S177W_L219F | 0.002 | 0.128 | 0.144 | 0.005 | 0.001 |
| 53 | V24_A17T_F213M_S214R | 0.0123 | 0.1368 | 0.0087 | 0.0052 | 0.0001 |
| 54 | V32_M162A_C209G_Y288H | 0.001 | 0.004 | 0.001 | 0.005 | 0.001 |
| 55 | V40_S177E_S214R_R228E | 0.002 | 0.002 | 0.001 | 0.004 | 0.001 |
| 56 | V48_V49L_E112D_G286E | 0.001 | 0.003 | 0.001 | 0.003 | 0.004 |
| 57 | V64_M106E_M162A_Y216A | 0.001 | 0.002 | 0.001 | 0.001 | 0.001 |
| 58 | V72_E112G_G205M_L298W | 0.005 | 0.07 | 0.173 | 0.004 | 0.002 |
| 59 | V80_M162A_N173D_S214F | 0.001 | 0.008 | 0.008 | 0.002 | 0.001 |
| 60 | V88_A108G_Q161S_G205M | 0.001 | 0.005 | 0.012 | 0.003 | 0.001 |
| 61 | Q38G_D166E | 0.003 | 0.021 | 0.061 | 0.004 | 0.003 |
| 62 | Q38G_Q295A | 0.028 | 0.23 | 0.243 | 0.006 | 0.024 |
| 63 | D166E_Q295A | 0.002 | 0.037 | 0.012 | 0.005 | 0.002 |
| 64 | L219F_V294N | 0.012 | 0.184 | 0.1 | 0.003 | 0.007 |
| 65 | L219F_Q295A | 0.002 | 0.045 | 0.008 | 0.004 | 0.001 |
| 66 | V294N_Q295A | 0.017 | 0.203 | 0.112 | 0.004 | 0.016 |
| 67 | A53Q_S177W | 0.002 | 0.093 | 0.088 | 0.003 | 0.001 |
| 68 | A53Q_L219F | 0.007 | 0.061 | 0.156 | 0.003 | 0.002 |
| 69 | S177W_L219F | 0.001 | 0.045 | 0.026 | 0.002 | 0.001 |
| 70 | A108G_Q161S | 0.001 | 0.003 | 0.006 | 0.003 | 0.001 |
| 71 | A108G_G205M | 0.001 | 0.001 | 0.002 | 0.001 | 0.001 |
| 72 | Q161S_G205M | 0.003 | 0.021 | 0.071 | 0.004 | 0.001 |
| 73 | F123H_L174V | 0.006 | 0.016 | 0.163 | 0.003 | 0.001 |
| 74 | F123H_S177E | 0.024 | 0.045 | 0.132 | 0.003 | 0.001 |
| 75 | L174V_S177E | 0.028 | 0.236 | 0.131 | 0.004 | 0.002 |
| 76 | A53T_D166E | 0.016 | 0.055 | 0.262 | 0.003 | 0.003 |
| 77 | A53T_Q295W | 0.027 | 0.115 | 0.13 | 0.007 | 0.005 |
| 78 | D166E_Q295W | 0.001 | 0.009 | 0.003 | 0.001 | 0.001 |
| 79 | A53Q_S177Y | 0.003 | 0.013 | 0.073 | 0.004 | 0.001 |
| 80 | A53Q_Y288H | 0.12 | 0.566 | 0.018 | 0.01 | 0.043 |
| 81 | S177Y_Y288H | 0.043 | 0.149 | 0.004 | 0.003 | 0.01 |
| 82 | V49A_Q161S | 0.006 | 0.026 | 0.017 | 0.001 | 0.002 |
| 83 | V49A_V294A | 0.014 | 0.053 | 0.021 | 0.003 | 0.008 |
| 84 | Q161S_V294A | 0.008 | 0.087 | 0.069 | 0.003 | 0.003 |
| 85 | A53T_M106E | 0.022 | 0.044 | 0.312 | 0.005 | 0.005 |
| 86 | A53T_Q161S | 0.008 | 0.032 | 0.184 | 0.002 | 0.002 |
| 87 | M106E_Q161S | 0.001 | 0.007 | 0.041 | 0.003 | 0.001 |
| 88 | A53T_K118N | 0.001 | 0.001 | 0.001 | 0.001 | 0.001 |
| 89 | A53T_S214F | 0.001 | 0.004 | 0.001 | 0.001 | 0.001 |
| 90 | K118N_S214F | 0.001 | 0.003 | 0.001 | 0.002 | 0.001 |
| 91 | A108G | 0.001 | 0.001 | 0.002 | 0.001 | 0.001 |
| 92 | A53Q | 0.014 | 0.111 | 0.236 | 0.004 | 0.006 |
| 93 | A53T | 0.056 | 0.223 | 0.608 | 0.009 | 0.014 |
| 94 | D166E | 0.007 | 0.049 | 0.096 | 0.001 | 0.003 |
| 95 | F123H | 0.003 | 0.011 | 0.143 | 0.003 | 0.002 |
| 96 | G205M | 0.009 | 0.067 | 0.099 | 0.001 | 0.005 |
| 97 | K118N | 0.001 | 0.007 | 0.012 | 0.004 | 0.001 |
| 98 | L219F | 0.009 | 0.065 | 0.094 | 0.001 | 0.006 |
| 99 | M106E | 0.003 | 0.011 | 0.038 | 0.001 | 0.002 |
| 100 | Q161S | 0.01 | 0.075 | 0.153 | 0.001 | 0.002 |
| 101 | Q295A | 0.015 | 0.196 | 0.039 | 0.001 | 0.005 |
| 102 | Q295W | 0.011 | 0.09 | 0.039 | 0.002 | 0.002 |
| 103 | Q38G | 0.006 | 0.056 | 0.068 | 0.002 | 0.003 |
| 104 | S177E | 0.02 | 0.178 | 0.099 | 0.002 | 0.001 |
| 105 | S177W | 0.001 | 0.11 | 0.05 | 0.002 | 0.001 |
| 106 | S177Y | 0.002 | 0.01 | 0.034 | 0.002 | 0.001 |
| 107 | S214F | 0.001 | 0.018 | 0.002 | 0.001 | 0.001 |
| 108 | V294A | 0.012 | 0.228 | 0.086 | 0.001 | 0.006 |
| 109 | V294N | 0.008 | 0.129 | 0.059 | 0.001 | 0.002 |
| 110 | V49A | 0.01 | 0.029 | 0.028 | 0.001 | 0.004 |
| ill | Y288H | 0.046 | 0.19 | 0.004 | 0.004 | 0.01 |
| 112 | K118Q | 0.0132 | 0.0342 | 0.3057 | 0.0054 | 0.0047 |

TABLE 12-continued

HPLC Area in mAU*min of prenylation products produced by Orf2 and Orf2 Variants when using DVA as substrate and FPP as donor

| ID# | Mutations | 7.05 | 7.84 | 8.03 | 8.24 | 9.72 |
|---|---|---|---|---|---|---|
| 113 | K119Q | 0.0005 | 0.0052 | 0.0046 | 0.0062 | 0.001 |
| 114 | M162A | 0.0024 | 0.172 | 0.1925 | 0.0082 | 0.0023 |
| 115 | Q161A | 0.0044 | 0.0514 | 0.1017 | 0.0065 | 0.0039 |
| 116 | K119D | 0.0268 | 0.2098 | 0.2511 | 0.0056 | 0.0218 |
| 117 | F123A | 0.021 | 0.1354 | 1.3582 | 0.0061 | 0.0206 |
| 118 | K118N | 0.0071 | 0.0207 | 0.0373 | 0.0076 | 0.0009 |
| 119 | Q161W | 0.0015 | 0.0054 | 0.0783 | 0.0033 | 0.0014 |
| 120 | D227E | 0.0189 | 0.0974 | 0.1951 | 0.0074 | 0.0121 |
| 121 | L274V | 0.0014 | 0.0197 | 0.0241 | 0.005 | 0.0007 |
| 122 | S214G | 0.0992 | 0.062 | 0.0761 | 0.0088 | 0.0242 |
| 123 | Y216A | 0.0004 | 0.0034 | 0.0002 | 0.0054 | 0.0004 |
| 124 | F123W | 0.0001 | 0.001 | 0.0005 | 0.0034 | 0.0006 |
| 125 | V271E | 0.0003 | 0.0019 | 0.0002 | 0.0052 | 0.0002 |
| 126 | N173D | 0.0001 | 0.0054 | 0.0044 | 0.0037 | 0.0004 |
| 127 | R228Q | 0.0004 | 0.0037 | 0.007 | 0.002 | 0.001 |
| 128 | M162F | 0.0034 | 0.0838 | 0.0372 | 0.0042 | 0.0007 |
| 129 | A232S | 0.0736 | 0.3959 | 0.1775 | 0.0081 | 0.0705 |
| 130 | C230S | 0.0056 | 0.0453 | 0.0599 | 0.0056 | 0.0007 |
| 131 | V294F | 0.0367 | 0.2267 | 0.5666 | 0.0063 | 0.0568 |
| 132 | Y283L | 0.0157 | 0.103 | 0.1708 | 0.0038 | 0.0094 |
| 133 | S214R | 0.2092 | 1.5553 | 0.0287 | 0.02 | 0.0003 |
| 134 | G286E | 0.0005 | 0.0137 | 0.0012 | 0.004 | 0.0002 |
| 135 | R228E | 0.0003 | 0.0002 | 0.0002 | 0.0063 | 0.0003 |
| 136 | A53T_V294A | 0.1099 | 0.7571 | 0.8358 | 0.0107 | 0.024 |
| 137 | A53T_Q161S_V294A | 0.0457 | 0.237 | 0.5362 | 0.0062 | 0.0092 |
| 138 | A53T_Q161S_V294N | 0.0284 | 0.1637 | 0.3764 | 0.0072 | 0.0031 |
| 139 | A53T_Q295A | 0.0723 | 0.5523 | 0.2617 | 0.0069 | 0.0264 |
| 140 | Q161S_V294A_Q295A | 0.0267 | 0.2413 | 0.1134 | 0.0059 | 0.005 |
| 141 | A53T_Q161S_Q295A | 0.0526 | 0.2354 | 0.2785 | 0.0298 | 0.0083 |
| 142 | A53T_V294A_Q295A | 0.1679 | 1.3931 | 0.6261 | 0.018 | 0.0747 |
| 143 | A53T_Q161S_V294A_Q295A | 0.0987 | 0.438 | 0.529 | 0.0187 | 0.0239 |
| 144 | A53T_Q161S_V294N_Q295A | 0.0526 | 0.2073 | 0.2919 | 0.0085 | 0.0073 |
| 145 | A53T_Q295W | 0.0593 | 0.2272 | 0.2566 | 0.0073 | 0.0132 |
| 146 | Q161S_V294A_Q295W | 0.0083 | 0.0846 | 0.0528 | 0.0045 | 0.0006 |
| 147 | A53T_Q161S_Q295W | 0.0193 | 0.1301 | 0.2282 | 0.0069 | 0.0043 |
| 148 | A53T_V294A_Q295W | 0.0792 | 0.2985 | 0.3506 | 0.0113 | 0.0114 |
| 149 | A53T_Q161S_V294A_Q295W | 0.0273 | 0.15 | 0.2829 | 0.0054 | 0.0049 |
| 150 | A53T_Q161S_V294N_Q295W | 0.0243 | 0.1498 | 0.2751 | 0.0049 | 0.006 |
| 151 | Q295C | 0.0177 | 0.2424 | 0.0441 | 0.006 | 0.0343 |
| 152 | Q295E | 0.0001 | 0.0176 | 0.003 | 0.0052 | 0.0006 |
| 153 | Q295F | 0.0479 | 0.6113 | 0.0275 | 0.0077 | 0.0235 |
| 154 | Q295G | 0.003 | 0.049 | 0.0223 | 0.0037 | 0.0019 |
| 155 | Q295H | 0.0304 | 0.1238 | 0.0444 | 0.0056 | 0.0527 |
| 156 | Q295I | 0.0048 | 0.1541 | 0.0032 | 0.0016 | 0.0198 |
| 157 | Q295L | 0.0377 | 1.3192 | 0.0344 | 0.0072 | 0.1094 |
| 158 | Q295M | 0.0223 | 0.4255 | 0.0354 | 0.0046 | 0.0423 |
| 159 | Q295N | 0.0073 | 0.0733 | 0.0359 | 0.0041 | 0.0074 |
| 160 | Q295D | 0.0109 | 0.151 | 0.0783 | 0.0063 | 0.0033 |
| 161 | Q295K | 0.001 | 0.0006 | 0.0005 | 0.0023 | 0.0003 |
| 162 | Q295P | 0.0003 | 0.0118 | 0.0055 | 0.0049 | 0.0001 |
| 163 | Q295R | 0.0002 | 0.0037 | 0.0002 | 0.0009 | 0.0006 |
| 164 | Q295S | 0.0052 | 0.1048 | 0.0373 | 0.0047 | 0.0059 |
| 165 | Q295T | 0.0094 | 0.105 | 0.0199 | 0.005 | 0.0166 |
| 166 | Q295V | 0.0984 | 1.0999 | 0.0506 | 0.0123 | 0.5476 |
| 167 | Q295Y | 0.013 | 0.1182 | 0.1458 | 0.006 | 0.0136 |
| 168 | Q295W | 0.0007 | 0.0114 | 0.0014 | 0.0002 | 0.0004 |
| 169 | WT Control | 0.009 | 0.0742 | 0.0788 | 0.0027 | 0.006 |
| 170 | S214D | 0.004 | 0.0423 | 0.0623 | 0.0071 | 0.0007 |
| 171 | S214E | 0.0052 | 0.0214 | 0.0101 | 0.0054 | 0.0002 |
| 172 | S214F | 0.0002 | 0.0281 | 0.0019 | 0.0047 | 0.0001 |
| 173 | S214H | 0.0087 | 0.0832 | 0.0011 | 0.0067 | 0.0002 |
| 174 | S214I | 0.0003 | 0.0279 | 0.0127 | 0.0055 | 0.001 |
| 175 | S214K | 0.0012 | 0.0374 | 0.0225 | 0.0039 | 0.0001 |
| 176 | S214L | 0.0012 | 0.0091 | 0.0007 | 0.0046 | 0.0006 |
| 177 | S214M | 0.0006 | 0.0175 | 0.0008 | 0.0055 | 0.0001 |
| 178 | S214N | 0.0707 | 0.0405 | 0.0921 | 0.0127 | 0.0004 |
| 179 | S214R | 0.1858 | 2.5018 | 0.057 | 0.0175 | 0.0022 |
| 180 | S214T | 0.0152 | 0.1339 | 0.1388 | 0.0046 | 0.0115 |
| 181 | S214V | 0.0108 | 0.1068 | 0.1132 | 0.0046 | 0.0062 |
| 182 | S214W | 0.0007 | 0.0008 | 0.0014 | 0.0043 | 0.0016 |
| 183 | S214Y | 0.0007 | 0.0004 | 0.0004 | 0.0039 | 0.0002 |
| 184 | Q161A | 0.0078 | 0.0912 | 0.1146 | 0.0021 | 0.0122 |
| 185 | Q161C | 0.0054 | 0.0515 | 0.4969 | 0.0055 | 0.009 |
| 186 | Q161D | 0.001 | 0.006 | 0.005 | 0.001 | 0.001 |
| 187 | Q161F | 0.0014 | 0.3198 | 0.256 | 0.0064 | 0.0013 |

TABLE 12-continued

HPLC Area in mAU*min of prenylation products produced by Orf2 and Orf2 Variants when using DVA as substrate and FPP as donor

| ID# | Mutations | 7.05 | 7.84 | 8.03 | 8.24 | 9.72 |
|---|---|---|---|---|---|---|
| 188 | Q161G | 0.0006 | 0.0155 | 0.0568 | 0.0066 | 0.001 |
| 189 | Q161H | 0.3945 | 19.8218 | 0.2343 | 0.0332 | 0.0283 |
| 190 | Q161I | 0.0058 | 0.0636 | 0.4341 | 0.0053 | 0.0095 |
| 191 | Q161K | 0.0095 | 0.2765 | 0.141 | 0.0036 | 0.0011 |
| 192 | Q161L | 0.0085 | 0.1492 | 0.5887 | 0.0075 | 0.0153 |
| 193 | Q161M | 0.015 | 0.0478 | 0.4349 | 0.006 | 0.0028 |
| 194 | Q161N | 0.0044 | 0.0422 | 0.1058 | 0.0051 | 0.0014 |
| 195 | Q161P | 0.001 | 0.01 | 0.023 | 0.001 | 0.001 |
| 196 | Q161Q | 0.0113 | 0.1271 | 0.1337 | 0.0047 | 0.0118 |
| 197 | Q161R | 0.0146 | 0.8334 | 0.4276 | 0.0062 | 0.0031 |
| 198 | Q161S | 0.0098 | 0.1224 | 0.2244 | 0.004 | 0.0055 |
| 199 | Q161T | 0.0085 | 0.214 | 0.4737 | 0.0055 | 0.0098 |
| 200 | Q161W | 0.001 | 0.004 | 0.045 | 0.002 | 0.001 |
| 201 | Q161Y | 0.0384 | 0.5159 | 0.2257 | 0.0045 | 0.0036 |
| 202 | A53D | 0.0041 | 0.0309 | 0.079 | 0.0044 | 0.0008 |
| 203 | A53E | 0.0007 | 0.0051 | 0.0024 | 0.0037 | 0.0004 |
| 204 | A53F | 0.001 | 0.0486 | 0.0016 | 0.0015 | 0.0001 |
| 205 | A53G | 0.0095 | 0.0276 | 0.0692 | 0.0073 | 0.0011 |
| 206 | A53H | 0.0164 | 0.0668 | 0.079 | 0.0089 | 0.0098 |
| 207 | A53K | 0.09 | 0.4495 | 0.973 | 0.0103 | 0.0542 |
| 208 | A53L | 0.1046 | 1.3768 | 1.9216 | 0.0108 | 0.0972 |
| 209 | A53M | 0.0238 | 0.2104 | 0.3487 | 0.0071 | 0.0198 |
| 210 | A53N | 0.0079 | 0.0336 | 0.0684 | 0.0054 | 0.0037 |
| 211 | A53P | 0.0004 | 0.0071 | 0.0069 | 0.0043 | 0.0002 |
| 212 | A53Q | 0.0285 | 0.2794 | 0.6075 | 0.0055 | 0.0178 |
| 213 | A53R | 0.008 | 0.04 | 0.077 | 0.002 | 0.003 |
| 214 | A53S | 0.0244 | 0.1586 | 0.2731 | 0.0069 | 0.0106 |
| 215 | A53T | 0.053 | 0.299 | 0.67 | 0.007 | 0.016 |
| 216 | A53V | 0.1704 | 0.7757 | 0.5053 | 0.0192 | 0.1256 |
| 217 | A53W | 0.002 | 0.013 | 0.038 | 0.002 | 0.001 |
| 218 | A53Y | 0.0063 | 0.0351 | 0.0357 | 0.0055 | 0.0059 |
| 219 | S177W_Q295A | 0.0489 | 5.7629 | 0.0051 | 0.0072 | 0.0116 |
| 220 | S177W_S214R | 0.0142 | 0.203 | 0.0024 | 0.0038 | 0.001 |
| 221 | Q161S_S177W | 0.0076 | 0.5362 | 0.0761 | 0.0017 | 0.0094 |
| 222 | A53T_S177W | 0.0148 | 0.4099 | 0.5618 | 0.0031 | 0.0085 |
| 223 | V49A_Q295L | 0.0023 | 0.0364 | 0.009 | 0.0351 | 0.0135 |
| 224 | V49A_S214R | 0.0263 | 0.6375 | 0.0121 | 0.0041 | 0.001 |
| 225 | A53T_Q295F | 0.1722 | 1.62 | 0.2003 | 0.0187 | 0.1032 |
| 226 | A53T_S214R | 0.2252 | 1.9636 | 0.0873 | 0.0226 | 0.0095 |
| 227 | A53T_A161S | 0.043 | 0.1852 | 0.8726 | 0.0054 | 0.0138 |
| 228 | Q161S_Q295F | 0.0266 | 0.4049 | 0.0432 | 0.0027 | 0.0339 |
| 229 | Q161S_Q295L | 0.0228 | 0.3622 | 0.0288 | 0.0039 | 0.025 |
| 230 | Q16S_S214R | 0.023 | 0.1759 | 0.0796 | 0.0028 | 0.0009 |
| 231 | S214R_Q295F | 0.576 | 6.1235 | 0.0155 | 0.0674 | 0.0111 |
| 232 | WT | 0.015 | 0.114 | 0.128 | 0.004 | 0.009 |
| 233 | WT | 0.019 | 0.129 | 0.15 | 0.004 | 0.012 |
| 234 | WT | 0.019 | 0.116 | 0.133 | 0.003 | 0.013 |
| 235 | WT | 0.016 | 0.157 | 0.143 | 0.002 | 0.011 |
| 236 | WT | 0.0118 | 0.0819 | 0.09 | 0.0048 | 0.0047 |
| 237 | WT | 0.0162 | 0.128 | 0.1362 | 0.0073 | 0.017 |
| 238 | WT | 0.0288 | 0.2778 | 0.2988 | 0.0051 | 0.0251 |
| 239 | WT | 0.0273 | 0.2258 | 0.2578 | 0.0069 | 0.0157 |
| 240 | WT | 0.0188 | 0.1259 | 0.1409 | 0.0034 | 0.0122 |
| 241 | WT | 0.0219 | 0.2037 | 0.2211 | 0.0077 | 0.0143 |

Figure 6:
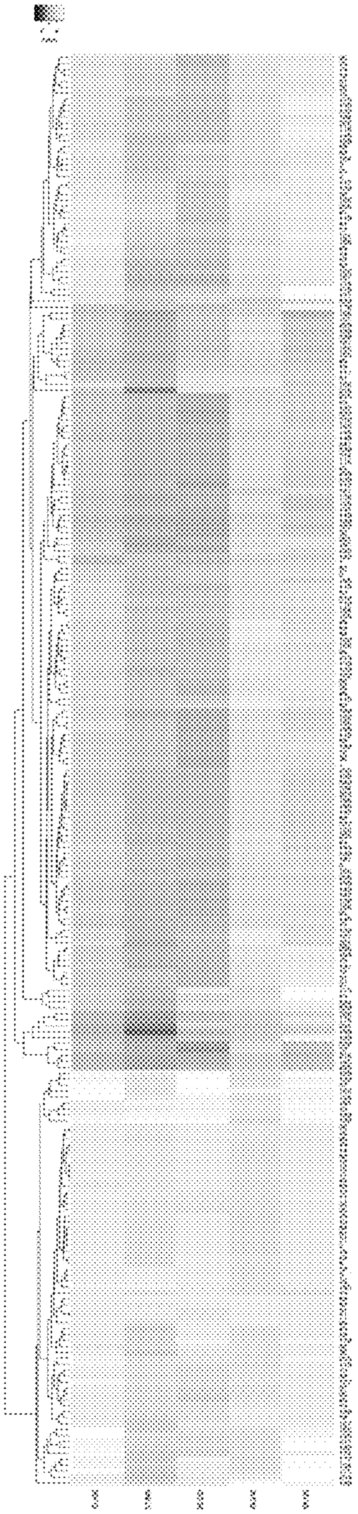
FIG. 6 shows a heatmap of prenylated products produced from Orf2 mutants when using DVA as substrate and FPP as donor.

The amount of each prenylation product was measured by HPLC. FIG. 6 shows a heatmap of the HPLC areas of each prenylation product generated using DVA as substrate and FPP as donor. Each column represents a single prenylation product and each row represents an Orf2 or Orf2 variant. Prenylation products are labeled by retention time. Enzyme variants are labeled by ID #as listed in Table 12.

Example 8: Generation of ORF2 Variants which Synthesize an Altered Amount of Prenylated Products when Using ORA as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position. A subset of Orf2 Mutant enzymes were screened for prenylation when using Orsillenic Acid (ORA) as substrate and GPP as donor.

The wild type Orf2 prenylation reaction using ORA as substrate and GPP as donor produces 6 products as detected by HPLC. The respective retention times of these products are approximately 4.6, 5.7, 5.83, 6.35, 7.26, and 9.26 minutes.

Table 13A provides a summary of the prenylation products produced from ORA and GPP, their retention times, and the hypothesized prenylation site on ORA. FIG. 22 shows the predicted chemical structures of the respective prenylation products.

TABLE 13A

Predicted prenylation products of Orf2 or Orf2 Mutants when using ORA as substrate and GPP as donor

| Molecule ID | Substrate | Donor | Attachment Site | Retention Time |
|---|---|---|---|---|
| UNK20 | ORA | GPP | CO | 4.557 |
| UNK21 | ORA | GPP | 2-O | 7.258 |
| UNK22 | ORA | GPP | 4-O | 6.353 |
| UNK23 | ORA | GPP | 3-C | 5.707 |
| UNK24 | ORA | GPP | 5-C | 5.828 |
| UNK59 | ORA | GPP | 5-C + 3-C | 9.263 |

Figure 82:
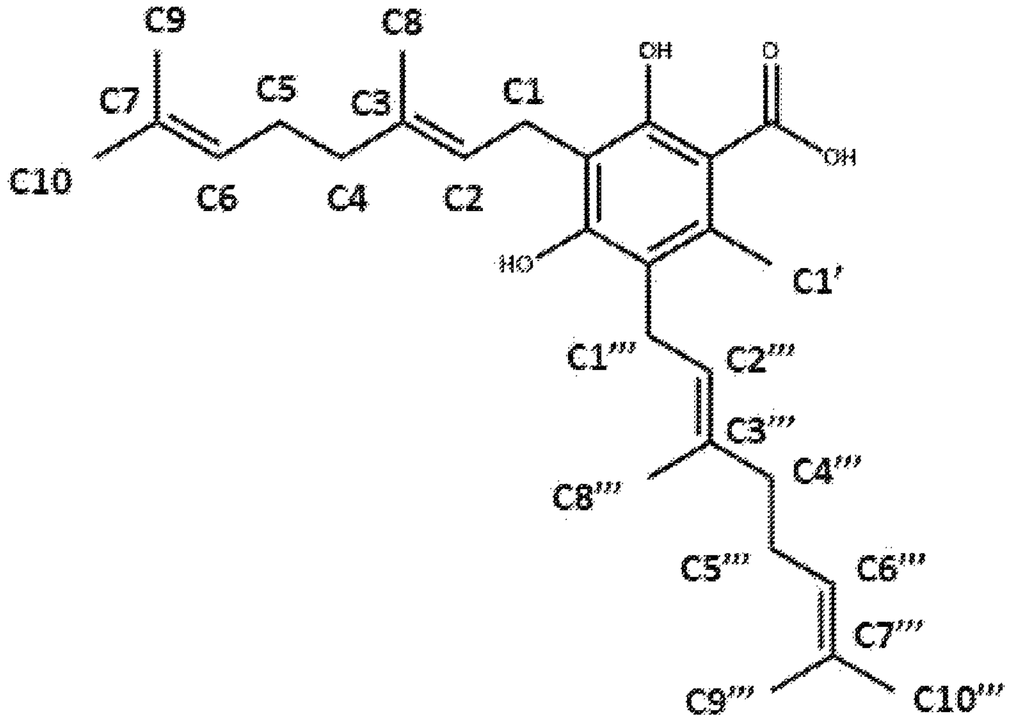
FIG. 82: Carbon and proton NMR assignments for UNK-59.

Tables 13B-13D provide NMR data of proton and carbon chemical shifts for UNK59 with (a) HSQC, (b) HMBC correlation and (c) final carbon and proton NMR assignments. The carbon and proton NMR assignments for UNK59 are shown in FIG. 82.

TABLE 13B

Proton NMR assignments for UNK59

| PROTON Shift | Area | Protons | C Assignment | HSQC-DEPT | MULTIPLICITY Options | MULTIPLICITY Actual |
|---|---|---|---|---|---|---|
| 1.528 | 3.07 | 3 | C9 | 1.52 | CH3 or CH | CH3 |
| 1.53 | 3.07 | 3 | C9''' | X | X | CH3 |
| 1.596 | 3.21 | 3 | C10 | 1.58 | CH3 or CH | CH3 |
| 1.6 | 2.92 | 3 | C10''' | X | X | CH3 |
| 1.711 | 3.01 | 3 | C8 or C8''' | 1.7 | CH3 or CH | CH3 |
| 1.715 | 2.96 | 3 | C8 or C8''' | 1.7 | CH3 or CH | CH3 |
| 1.902 | 1.9 | 2 | C4''' | 1.9 | CH2 | CH2 |
| 1.938 | 2 | 2 | C4 | 1.92 | CH2 | CH2 |
| 2.006 | 4.21 | 4 | C5 + C5''' | 1.99 | CH2 | CH2 |
| 2.34 | 3.03 | 3 | C1''? | 2.33 | CH3 or CH | CH3 |
| 3.287 | 2.05 | 2 | C1 Or C1''' | 3.28 | CH2 | CH2 |
| 3.298 | 2.35 | 2 | C1 Or C1''' | 3.28 | CH2 | CH2 |
| 4.921 | 1 | 1 | C6''' | 4.9 | CH3 or CH | CH |
| 5.026 | 1.02 | 1 | C6 OR C2''' | 5.02 | CH3 or CH | CH |
| 5.04 | 1.08 | 1 | C6 OR C2''' | 5.09 | CH3 or CH | CH |
| 5.101 | 1.09 | 1 | C2 | X | X | CH |
| 8.857 | 0.968 | 1 | 4' OH? | X | X | X |
| 11.95 | 0.994 | 1 | 2' OH? | X | X | X |
| 13.5 | 1 | 1 | COOH? | X | X | X |
| | H Sum: | 40 | | | | |

TABLE 13C

Carbon NMR assignments for UNK59

| CARBON Shift | Assignment | Carbon ct. | NMR Predictions |
|---|---|---|---|
| 16.43 | C8 | 1 | 16.4 |
| 16.48 | C8''' | 1 | 16.4 |
| 17.98 | C9 | 1 | 18.6 |
| 18 | C9''' | 1 | 18.6 |
| 18.4 | C1'' | 1 | 14.2 |
| 22.48 | C1 | 1 | 22.2 |
| 25.43 | C1''' | 1 | 24.8 |
| 25.91 | C10 | 1 | 24.6 |
| 25.93 | C10''' | 1 | 24.6 |
| 26.56 | C5 | 1 | 26.4 |
| 26.65 | C5''' | 1 | 26.4 |
| 39.7 | C4 + C4''' | 2 | 39.7 |
| 106.7 | C1' | 1 | 107.2 |
| 113.29 | C3' | 1 | 113 |
| 120.6 | C2 | 1 | 122.3 |
| 123.15 | C2''' | 1 | 122.3 |
| 123.8 | C6 | 1 | 123.5 |
| 124.55 | C6''' | 1 | 123.5 |
| 124.59 | C5' | 1 | 126 |
| 131.07 | C7 | 1 | 132 |
| 131.1 | C7''' | 1 | 132 |
| 134.12 | C3 | 1 | 136.5 |
| 134.26 | C3''' | 1 | 136.5 |
| 137.56 | C6' | 1 | 139.3 |
| 157.44 | C2' | 1 | 156.9 |
| 159.71 | C4' | 1 | 158.3 |
| 174.43 | COOH | 1 | 173.2 |
| | CSUM: | 28 | |

TABLE 13D

| HMBC for sample UNK59 | | | | | |
|---|---|---|---|---|---|
| 1D C Shift | Assignment | Associated Proton Shifts | | Proton List | |
| 16.43 | C9''' | 4.92 | | C6''' | |
| 16.48 | C8 | 5.1 | | C2 | |
| 17.98 | C8''' | 5.03 | | C2''' | |
| 18 | C9 | 1.59 | | C10 | |
| 18.4 | C1'' | X | | | |
| 22.48 | C1 | X | | | |
| 25.43 | C1''' | X | | | |
| 25.91 | C10 | 1.52 | | C9 | |
| 25.93 | C10''' | 5.02 | | C2''' | |
| 26.56 | C5 | 1.94 | | C4 | |
| 26.65 | C5''' | 1.9 | | C4''' | |
| 39.89 | 1.79 | 1.98 | | C8 or C8''' | C5 + C5''' |
| 106.7 | C1' | 2.34 | | C1''? | |
| 113.29 | C3' | 8.86 | | 4' OH? | |
| 120.6 | C2 | 3.29 | | C1 + C1'' | |
| 123.15 | C2''' | 1.89 | 8.86 | C4''' | |
| 123.8 | C6 | 3.29 | | C1 + C1'' | |
| 124.55 | C6''' | X | | | |
| 124.59 | C5' | 1.52 | | C9 | |
| 131.07 | C7 | X | | | |
| 131.1 | C7''' | 1.52 | | C9 | |
| 134.12 | C3 | X | | | |
| 134.26 | C3''' | 1.71 | | C8 o rC8''' | |
| 137.56 | C6' | 3.29 | 1.99 | C5 + C5''' | C1 + C1'' |
| 157.44 | C2' | 2.33 | | C1''? | |
| 159.71 | C4' | X | | | |
| 174.43 | COOH | X | | | |

Table 14 provides a summary of the analysis performed on the enzymatic activity of the ORF2 variants to produce prenylated products using ORA as substrate and GPP as donor. Table 14 lists the mutations within each of the mutants analyzed as well mAU*min areas from the HPLC analysis of the reaction products.

TABLE 14

| HPLC Area in mAU*min of prenylation products produced by Orf2 and Orf2 Variants when using ORA as substrate and GPP as donor | | | | | | | |
|---|---|---|---|---|---|---|---|
| ID# | Mutations | 4.557 | 5.707 | 5.828 | 6.353 | 7.258 | 9.263 |
| 1 | A53Q + Y288H | 0.3283 | 14.2943 | 0.5313 | 0.6722 | 2.6632 | 4.0885 |
| 2 | Q161S + V294A | 0.0102 | 26.4403 | 0.4963 | 0.1372 | 0.2948 | 0.4523 |
| 3 | A53T | 0.0335 | 61.3252 | 1.0407 | 0.7123 | 3.1675 | 1.3286 |
| 4 | Q295A | 0.0347 | 32.3728 | 0.4799 | 0.4833 | 0.8491 | 3.3298 |
| 5 | Q295W | 0.1928 | 15.2688 | 1.5169 | 1.1091 | 4.357 | 4.0242 |
| 6 | V294A | 0.0865 | 51.226 | 0.867 | 0.3911 | 1.2826 | 0.3834 |
| 7 | Q295F | 0.1585 | 13.9454 | 1.4399 | 0.9662 | 2.1466 | 2.3094 |
| 8 | Q295H | 0.0455 | 41.0933 | 0.8956 | 0.4223 | 0.9599 | 0.5652 |
| 9 | S214R | 0.0167 | 12.2428 | 0.1388 | 0.2801 | 0.1169 | 4.9605 |
| 10 | WT | 0.0284 | 50.6006 | 0.8257 | 0.2747 | 1.6682 | 1.6355 |

Figure 7:
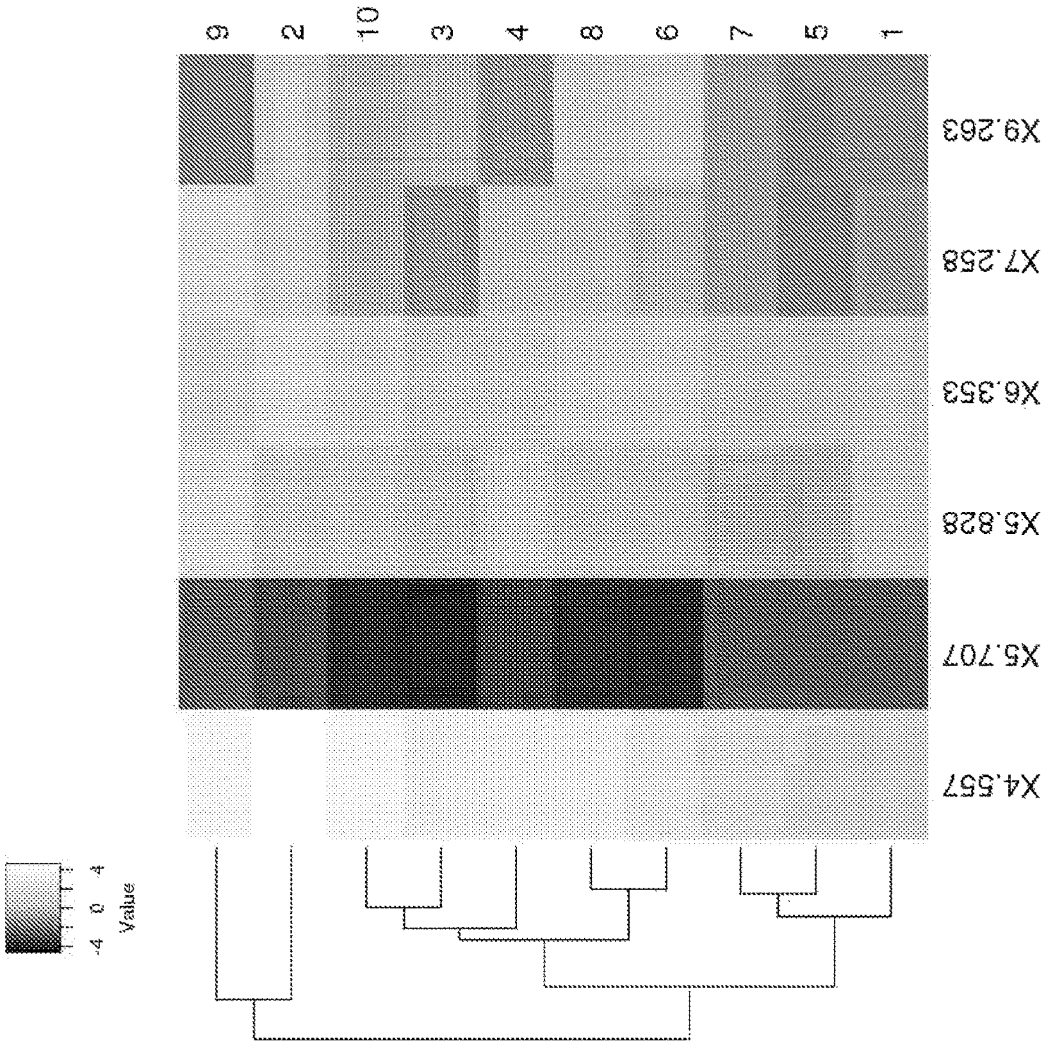
FIG. 7 shows a heatmap of prenylated products produced from selected Orf2 mutants when using ORA as substrate and GPP as donor.

The amount of each prenylation product was measured by HPLC. FIG. 7 shows a heatmap of the HPLC areas of each prenylation product generated using ORA as substrate and GPP as donor. Each column represents a single prenylation product and each row represents an Orf2 or Orf2 variant. Prenylation products are labeled by retention time. Enzyme variants are labeled by ID #as listed in Table 14.

Example 9: Generation of ORF2 Variants which Synthesize an Altered Amount of Prenylated Products when Using Apigenin as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position. A subset of Orf2 Mutant enzymes were screened for prenylation when using Apigenin as substrate and GPP as donor.

The wild type Orf2 prenylation reaction using Apigenin as substrate and GPP as donor produces 5 products as detected by HPLC. The respective retention times of these products are approximately 5.84, 6.77, 7.36, 7.68, and 8.19 minutes.

Table 15 provides a summary of the prenylation products produced from Apigenin and GPP, their retention times, and the hypothesized prenylation site on Apigenin. FIG. 23 shows the predicted chemical structures of the respective prenylation products.

TABLE 15

| Predicted prenylation products of Orf2 or Orf2 Mutants when using Apigenin as substrate and GPP as donor | | | | |
|---|---|---|---|---|
| Molecule ID | Substrate | Donor | Attachment Site | Retention Time |
| UNK47 | Apigenin | GPP | C-13/C-15 | 5.84 |
| UNK48 | Apigenin | GPP | C-3 | 6.77 |
| UNK49 | Apigenin | GPP | C-12/C-16 | 7.36 |
| UNK50 | Apigenin | GPP | C-9 | 7.68 |
| UNK51 | Apigenin | GPP | C-5 | 8.19 |

Table 16 provides a summary of the analysis performed on the enzymatic activity of the ORF2 variants to produce prenylated products using Apigenin as substrate and GPP as donor. Table 16 lists the mutations within each of the mutants analyzed as well mAU*min areas from the HPLC analysis of the reaction products.

TABLE 16

| HPLC Area in mAU*min of prenylation products produced by Orf2 and Orf2 Variants when using Apigenin as substrate and GPP as donor | | | | | | |
|---|---|---|---|---|---|---|
| ID# | Mutations | 5.84 | 6.77 | 7.36 | 7.68 | 8.19 |
| 1 | Q295C | 0.037 | 0.656 | 0.079 | 0.844 | 0.028 |
| 2 | Q295E | 0.008 | 0.512 | 0.01 | 0.065 | 0.035 |
| 3 | Q295F | 0.881 | 8.074 | 0.332 | 0.949 | 0.037 |
| 4 | Q295G | 0.036 | 0.184 | 0.032 | 0.375 | 0.018 |
| 5 | Q295H | 0.098 | 1.299 | 0.007 | 0.281 | 0.008 |
| 6 | Q295I | 0.033 | 0.744 | 0.118 | 3.573 | 0.148 |
| 7 | Q295L | 0.073 | 1.146 | 0.221 | 10.153 | 0.042 |
| 8 | Q295M | 0.337 | 3.197 | 0.213 | 4.572 | 0.029 |
| 9 | Q295N | 0.012 | 0.095 | 0.024 | 0.143 | 0.012 |
| 10 | Q295D | 0.014 | 0.295 | 0.024 | 0.052 | 0.015 |
| 11 | Q295K | 0.007 | 0.044 | 0.021 | 0.029 | 0.004 |
| 12 | Q295P | 0.007 | 0.028 | 0.003 | 0.025 | 0.003 |
| 13 | Q295R | 0.005 | 0.011 | 0.001 | 0.002 | 0.003 |
| 14 | Q295S | 0.015 | 0.158 | 0.023 | 0.242 | 0.018 |
| 15 | Q295T | 0.017 | 0.14 | 0.016 | 1.154 | 0.011 |
| 16 | Q295V | 0.017 | 0.124 | 0.039 | 1.275 | 0.034 |
| 17 | Q295Y | 0.031 | 3.792 | 0.048 | 3.475 | 0.053 |
| 18 | Q295W | 0.606 | 6.037 | 0.11 | 0.303 | 0.014 |
| 19 | Q295A | 0.024 | 0.17 | 0.029 | 0.636 | 0.032 |
| 20 | Q295Q | 0.051 | 6.947 | 0.107 | 7.634 | 0.209 |
| 21 | WT | 0.049 | 5.977 | 0.104 | 5.551 | 0.17 |
| 22 | S214E | 0.008 | 0.234 | 0.002 | 0.221 | 0.101 |
| 23 | S214H | 0.005 | 0.216 | 0.001 | 0.01 | 0.013 |
| 24 | S214Q | 0.008 | 0.107 | 0.003 | 0.012 | 0.038 |
| 25 | S214R | 0.01 | 0.119 | 0.003 | 0.688 | 0.1 |
| 26 | Q161A | 0.115 | 40.518 | 0.579 | 7.562 | 0.456 |
| 27 | Q161C | 0.026 | 19.176 | 0.487 | 3.827 | 0.256 |
| 28 | Q161D | 0.033 | 0.563 | 0.016 | 0.595 | 0.027 |
| 29 | Q161E | 0.065 | 0.664 | 0.019 | 0.633 | 0.028 |
| 30 | Q161F | 0.019 | 5.93 | 0.096 | 1.626 | 0.674 |
| 31 | Q161G | 1.071 | 36.638 | 0.561 | 4.654 | 0.461 |
| 32 | Q161H | 0.156 | 10.678 | 0.221 | 7.605 | 0.211 |
| 33 | Q161I | 0.017 | 32.007 | 0.281 | 8.586 | 0.639 |
| 34 | Q161K | 0.042 | 27.674 | 0.412 | 9.077 | 0.591 |
| 35 | Q161L | 0.009 | 3.693 | 0.115 | 2.828 | 0.124 |
| 36 | Q161M | 0.011 | 2.368 | 0.145 | 1.264 | 0.099 |
| 37 | Q161N | 0.02 | 3.968 | 0.078 | 2.371 | 0.069 |
| 38 | Q161P | 0.057 | 31.048 | 0.831 | 1.91 | 0.168 |
| 39 | Q161Q | 0.085 | 8.857 | 0.123 | 7.771 | 0.229 |
| 40 | Q161R | 0.034 | 5.103 | 0.655 | 33.99 | 0.143 |
| 41 | Q161S | 0.276 | 29.936 | 0.543 | 6.19 | 0.204 |
| 42 | Q161T | 0.05 | 21.028 | 0.272 | 8.879 | 0.163 |
| 43 | Q161V | 0.033 | 39.061 | 0.513 | 7.092 | 0.539 |
| 44 | Q161W | 0.012 | 14.605 | 0.283 | 19.196 | 0.013 |
| 45 | Q161Y | 0.018 | 3.813 | 0.032 | 2.387 | 0.091 |
| 46 | WT | 0.027 | 3.054 | 0.066 | 2.948 | 0.09 |
| 47 | V294A_ Q161S | 0.584 | 7.832 | 0.386 | 6.468 | 0.235 |
| 48 | A53T | 0.941 | 11.324 | 0.131 | 5.903 | 0.575 |
| 49 | Q161S | 0.453 | 11.836 | 0.18 | 2.99 | 0.305 |

TABLE 16-continued

| HPLC Area in mAU*min of prenylation products produced by Orf2 and Orf2 Variants when using Apigenin as substrate and GPP as donor | | | | | | |
|---|---|---|---|---|---|---|
| ID# | Mutations | 5.84 | 6.77 | 7.36 | 7.68 | 8.19 |
| 50 | Q295A | 0.019 | 0.263 | 0.019 | 0.722 | 0.042 |
| 51 | Q295W | 0.968 | 8.572 | 0.161 | 0.416 | 0.022 |
| 52 | V294A | 0.144 | 2.117 | 0.177 | 6.328 | 0.193 |
| 53 | WT | 0.132 | 7.706 | 0.103 | 7.002 | 0.304 |

Figure 8:
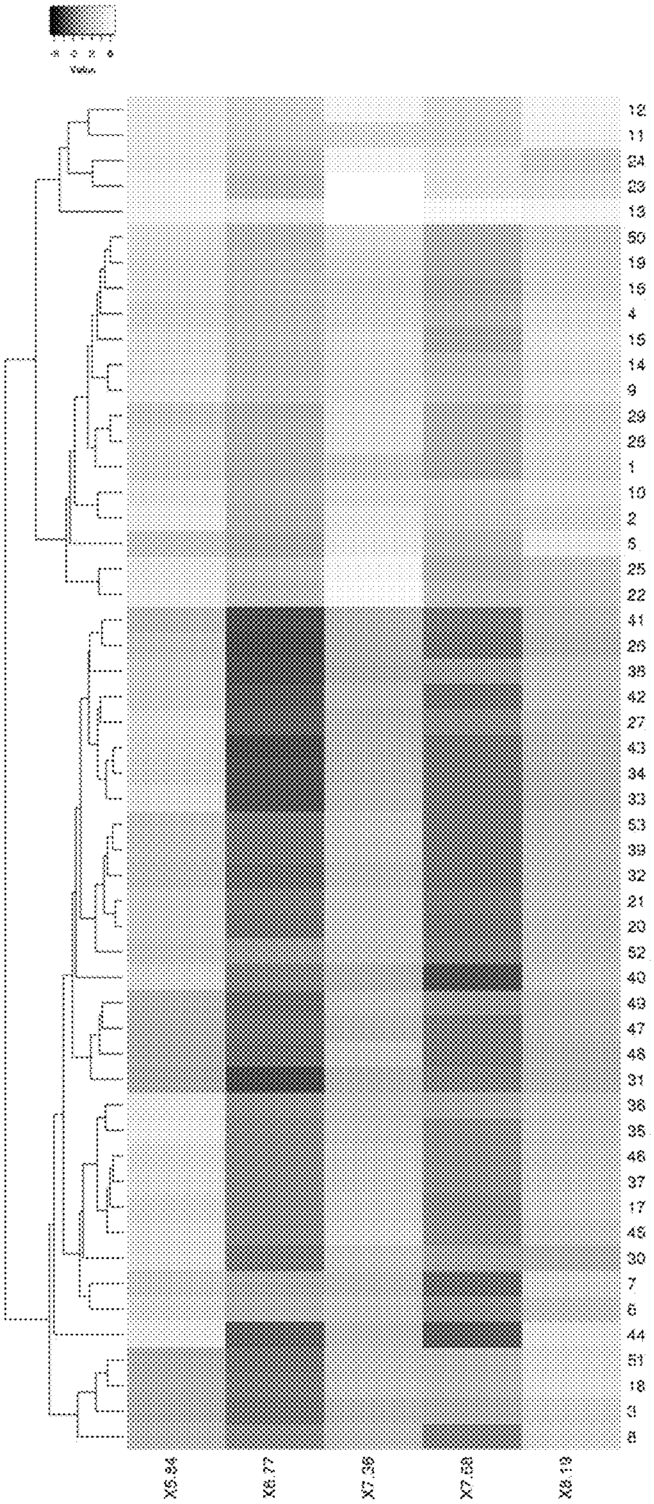
FIG. 8 shows a heatmap of prenylated products produced from selected Orf2 mutants when using Apigenin as substrate and GPP as donor.

The amount of each prenylation product was measured by HPLC. FIG. 8 shows a heatmap of the HPLC areas of each prenylation product generated using Apigenin as substrate and GPP as donor. Each column represents a single prenylation product and each row represents an Orf2 or Orf2 variant. Prenylation products are labeled by retention time. Enzyme variants are labeled by ID #as listed in Table 16.

Example 10: Generation of ORF2 Variants which Synthesize an Altered Amount of Prenylated Products when Using Naringenin as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position. A subset of Orf2 Mutant enzymes were screened for prenylation when using Naringenin as substrate and GPP as donor.

The wild type Orf2 prenylation reaction using Naringenin as substrate and GPP as donor produces 2 products as detected by HPLC. The respective retention times of these products are approximately 6.86 and 7.49 minutes.

Table 17 provides a summary of the prenylation products produced from Naringenin and GPP, their retention times, and the hypothesized prenylation site on Naringenin. FIG. 24 shows the predicted chemical structures of the respective prenylation products.

TABLE 17

| Predicted prenylation products of Orf2 or Orf2 Mutants when using Naringenin as substrate and GPP as donor | | | | |
|---|---|---|---|---|
| Molecule ID | Substrate | Donor | Attachment Site | Retention Time |
| RBI-41 | Naringenin | GPP | C-3 | 6.86 |
| RBI-42 | Naringenin | GPP | C-5 | 7.49 |

Table 18 provides a summary of the analysis performed on the enzymatic activity of the ORF2 variants to produce prenylated products using Naringenin as substrate and GPP as donor. Table 18 lists the mutations within each of the mutants analyzed as well mAU*min areas from the HPLC analysis of the reaction products.

TABLE 18

HPLC Area in mAU*min of prenylation products produced by Orf2 and Orf2 Variants when using Naringenin as substrate and GPP as donor

| ID # | Mutations | 6.86 | 7.49 |
|---|---|---|---|
| 1 | WT | 8.202 | 31.829 |
| 2 | Q295C | 2.253 | 2.131 |
| 3 | Q295E | 0.642 | 0.105 |
| 4 | Q295F | 6.571 | 1.125 |
| 5 | Q295G | 0.658 | 0.37 |
| 6 | Q295H | 3.33 | 42.881 |
| 7 | Q295I | 0.748 | 3.277 |
| 8 | Q295L | 1.539 | 16.474 |
| 9 | Q295M | 3.364 | 6.71 |
| 10 | Q295N | 0.472 | 0.522 |
| 11 | Q295D | 0.534 | 0.051 |
| 12 | Q295K | 0.359 | 0.04 |
| 13 | Q295P | 0.311 | 0.039 |
| 14 | Q295R | 0.209 | 0.006 |
| 15 | Q295S | 0.34 | 0.2 |
| 16 | Q295T | 0.306 | 0.199 |
| 17 | Q295V | 0.828 | 2.854 |
| 18 | Q295Y | 15.157 | 44.511 |
| 19 | Q295W | 6.094 | 0.324 |
| 20 | Q295A | 0.703 | 0.806 |
| 21 | Q295Q | 17.351 | 24.072 |
| 22 | WT | 16.28 | 29.481 |
| 23 | S214E | 1.438 | 0.97 |
| 24 | S214H | 0.85 | 0.092 |
| 25 | S214Q | 2.065 | 0.129 |
| 26 | S214R | 0.237 | 5.428 |
| 27 | Q161A | 9.731 | 20.938 |
| 28 | Q161C | 22.728 | 5.655 |
| 29 | Q161D | 3.005 | 8.28 |
| 30 | Q161E | 2.627 | 10.858 |
| 31 | Q161F | 11.362 | 2.239 |
| 32 | Q161G | 4.44 | 4.066 |
| 33 | Q161H | 5.966 | 11.015 |
| 34 | Q161I | 34.974 | 29.071 |
| 35 | Q161K | 18.385 | 21.875 |
| 36 | Q161L | 22.325 | 13.502 |
| 37 | Q161M | 14.437 | 8.335 |
| 38 | Q161N | 4.897 | 9.208 |
| 39 | Q161P | 4.697 | 1.86 |
| 40 | Q161Q | 10.32 | 23.439 |
| 41 | Q161R | 3.622 | 32.151 |
| 42 | Q161S | 17.823 | 22.064 |
| 43 | Q161T | 20.046 | 51.667 |
| 44 | Q161V | 57.983 | 24.995 |
| 45 | Q161W | 32.888 | 64.656 |
| 46 | Q161Y | 38.983 | 19.701 |
| 47 | WT | 8.581 | 34.506 |
| 48 | V294A_Q161S | 10.737 | 18.441 |
| 49 | A53T | 19.936 | 21.86 |
| 50 | Q161S | 15.186 | 18.466 |
| 51 | Q295A | 2.624 | 4.295 |
| 52 | Q295W | 9.322 | 0.573 |
| 53 | V294A | 2.607 | 15.69 |
| 54 | WT2 | 11.047 | 32.557 |

Figure 9:
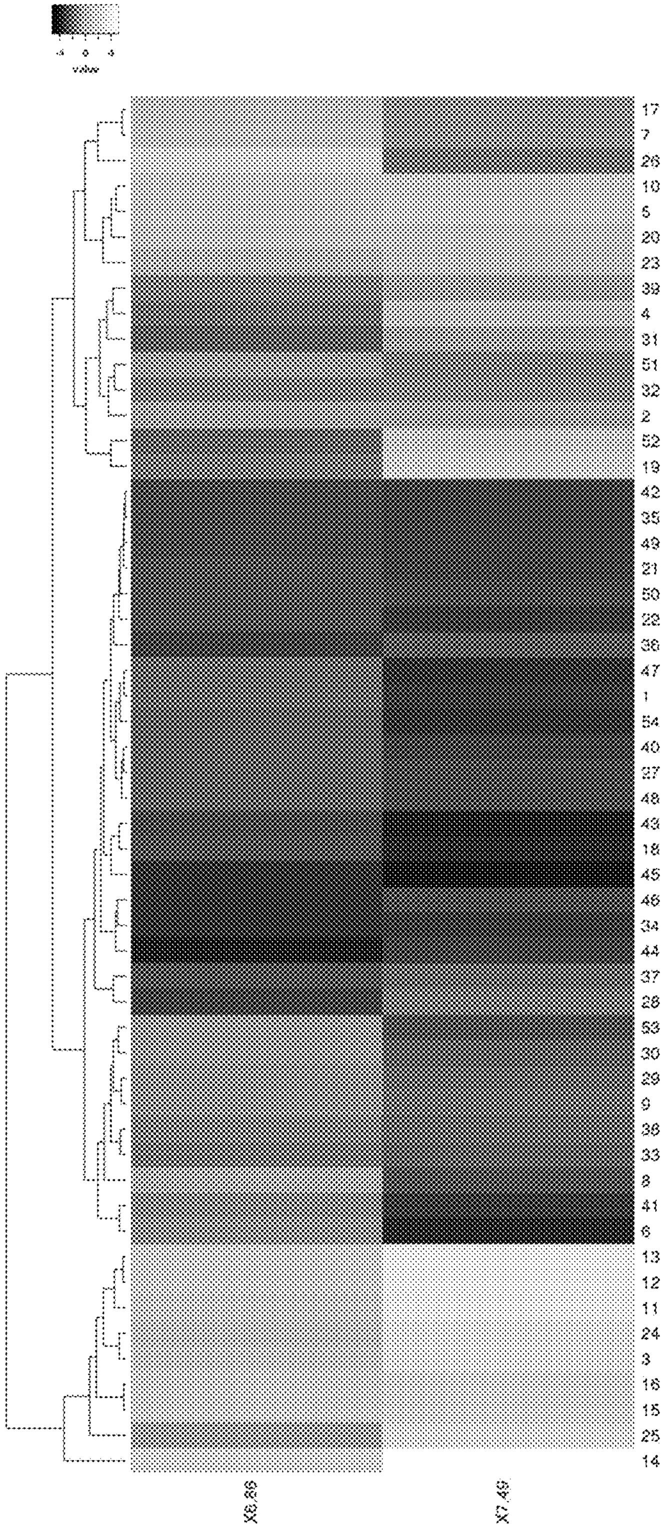
FIG. 9 shows a heatmap of prenylated products produced from selected Orf2 mutants when using Naringenin as substrate and GPP as donor.

The amount of each prenylation product was measured by HPLC. FIG. 9 shows a heatmap of the HPLC areas of each prenylation product generated using Naringenin as substrate and GPP as donor. Each column represents a single prenylation product and each row represents an Orf2 or Orf2 variant. Prenylation products are labeled by retention time. Enzyme variants are labeled by ID #as listed in Table 18.

Example 11: Generation of ORF2 Variants which Synthesize an Altered Amount of Prenylated Products when Using Reservatrol as Substrate and GPP as Donor A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1. Clones that exhibited improved function relative to the wild type enzyme were subjected to "breakdown" analysis. "Breakdown" analysis involves creating all possible combinations of double mutations and all single combinations from the parental tripleton yielding 6 unique variant enzymes from a single parental tripleton. "Breakdown" variants were used to identify residues for site saturation where all 19 other amino acids were substituted at a single position. A subset of Orf2 Mutant enzymes were screened for prenylation when using Reservatrol as substrate and GPP as donor.

The wild type Orf2 prenylation reaction using Reservatrol as substrate and GPP as donor produces 4 products as detected by HPLC. The respective retention times of these products are approximately 5.15, 5.87, 7.3, and 8.44 minutes.

Table 19 provides a summary of the prenylation products produced from Reservatrol and GPP, their retention times, and the hypothesized prenylation site on Reservatrol. FIG. 25 show the predicted chemical structures of the respective prenylation products.

TABLE 19

Predicted prenylation products of Orf2 or Orf2 Mutants when using Reservatrol as substrate and GPP as donor

| Molecule ID | Substrate | Donor | Attachment Site | Retention Time |
|---|---|---|---|---|
| RBI-49 | Resveratrol | GPP | C-11/C-13 | 5.15 |
| RBI-48 | Resveratrol | GPP | C-3 | 5.87 |
| UNK52 | Resveratrol | GPP | C-10/C-14 | 7.3 |
| UNK53 | Resveratrol | GPP | C-1/5 | 8.44 |

Table 20 provides a summary of the analysis performed on the enzymatic activity of the ORF2 variants to produce prenylated products using Reservatrol as substrate and GPP as donor. Table 20 lists the mutations within each of the mutants analyzed as well mAU*min areas from the HPLC analysis of the reaction products.

TABLE 20

HPLC Area in mAU*min of prenylation products produced by Orf2 and Orf2 Variants when using Reservatrol as substrate and GPP as donor

| ID# | Mutations | 5.15 | 5.87 | 7.3 | 8.44 |
|---|---|---|---|---|---|
| 1 | WT | 0.072 | 2.459 | 0.048 | 0.469 |
| 2 | Q295C | 0.246 | 18.951 | 0.212 | 1.203 |
| 3 | Q295E | 0.014 | 0.478 | 0.057 | 0.109 |
| 4 | Q295F | 0.149 | 1.98 | 0.14 | 0.099 |
| 5 | Q295G | 0.037 | 3.468 | 0.09 | 0.287 |
| 6 | Q295H | 0.489 | 22.335 | 0.364 | 3.931 |

TABLE 20-continued

HPLC Area in mAU*min of prenylation products produced by Orf2 and Orf2 Variants when using Reservatrol as substrate and GPP as donor

| ID# | Mutations | 5.15 | 5.87 | 7.3 | 8.44 |
|---|---|---|---|---|---|
| 7 | Q295I | 0.243 | 9.527 | 0.286 | 1.362 |
| 8 | Q295L | 0.045 | 5.68 | 0.13 | 0.45 |
| 9 | Q295M | 0.136 | 6.969 | 0.21 | 0.819 |
| 10 | Q295N | 0.048 | 1.249 | 0.057 | 0.033 |
| 11 | Q295D | 0.031 | 1.5 | 0.076 | 0.066 |
| 12 | Q295K | 0.032 | 0.354 | 0.062 | 0.001 |
| 13 | Q295P | 0.024 | 0.604 | 0.066 | 0.035 |
| 14 | Q295R | 0.008 | 0.082 | 0.07 | 0.001 |
| 15 | Q295S | 0.05 | 3.534 | 0.07 | 0.126 |
| 16 | Q295T | 0.026 | 4.023 | 0.067 | 0.589 |
| 17 | Q295V | 0.113 | 11.513 | 0.156 | 1.525 |
| 18 | Q295Y | 0.014 | 2.113 | 0.084 | 0.419 |
| 19 | Q295W | 0.308 | 2.323 | 0.15 | 0.24 |
| 20 | Q295A | 0.064 | 10.437 | 0.115 | 0.842 |
| 21 | Q295Q | 0.019 | 2.981 | 0.083 | 0.59 |
| 22 | WT | 0.017 | 2.104 | 0.072 | 0.397 |
| 23 | S214E | 0.032 | 31.678 | 0.117 | 2.491 |
| 24 | S214H | 0.023 | 33.632 | 0.018 | 0.433 |
| 25 | S214Q | 0.033 | 46.708 | 0.058 | 2.431 |
| 26 | S214R | 0.086 | 0.851 | 0.02 | 0.018 |
| 27 | Q161A | 0.254 | 5.286 | 0.082 | 1.987 |
| 28 | Q161C | 0.358 | 32.321 | 0.15 | 2.578 |
| 29 | Q161D | 0.059 | 13.127 | 0.173 | 1.02 |
| 30 | Q161E | 0.073 | 6.357 | 0.092 | 0.347 |
| 31 | Q161F | 0.073 | 6.956 | 0.085 | 0.678 |
| 32 | Q161G | 10.292 | 2.309 | 1.037 | 27.413 |
| 33 | Q161H | 0.048 | 21.619 | 0.089 | 2.828 |
| 34 | Q161I | 0.131 | 13.601 | 0.118 | 2.778 |
| 35 | Q161K | 0.318 | 3.085 | 0.09 | 1.716 |
| 36 | Q161L | 0.023 | 23.734 | 0.099 | 2.929 |
| 37 | Q161M | 0.02 | 18.21 | 0.103 | 2.641 |
| 38 | Q161N | 0.02 | 1.342 | 0.041 | 0.107 |
| 39 | Q161P | 0.054 | 1.494 | 0.034 | 0.481 |
| 40 | Q161Q | 0.031 | 3.151 | 0.049 | 0.894 |
| 41 | Q161R | 0.357 | 2.428 | 0.092 | 2.265 |
| 42 | Q161S | 0.022 | 9.936 | 0.101 | 3.788 |
| 43 | Q161T | 0.019 | 6.117 | 0.051 | 1.709 |
| 44 | Q161V | 0.036 | 7.982 | 0.071 | 1.898 |
| 45 | Q161W | 0.003 | 1.471 | 0.045 | 0.124 |
| 46 | Q161Y | 0.007 | 2.943 | 0.049 | 0.368 |
| 47 | WT | 0.016 | 1.044 | 0.047 | 0.168 |
| 48 | V294A_ Q161S | 0.328 | 17.675 | 0.288 | 6.416 |
| 49 | A53T | 0.075 | 12.785 | 0.099 | 3.09223 |
| 50 | Q161S | 0.076 | 12.144 | 0.086 | 4.129 |
| 51 | Q295A | 0.017 | 3.542 | 0.031 | 0.403 |
| 52 | Q295W | 0.588 | 2.626 | 0.071 | 0.288 |
| 53 | V294A | 0.216 | 11.208 | 0.131 | 2.357 |
| 54 | WT2 | 0.072 | 3.864 | 0.018 | 0.617 |

Figure 10:
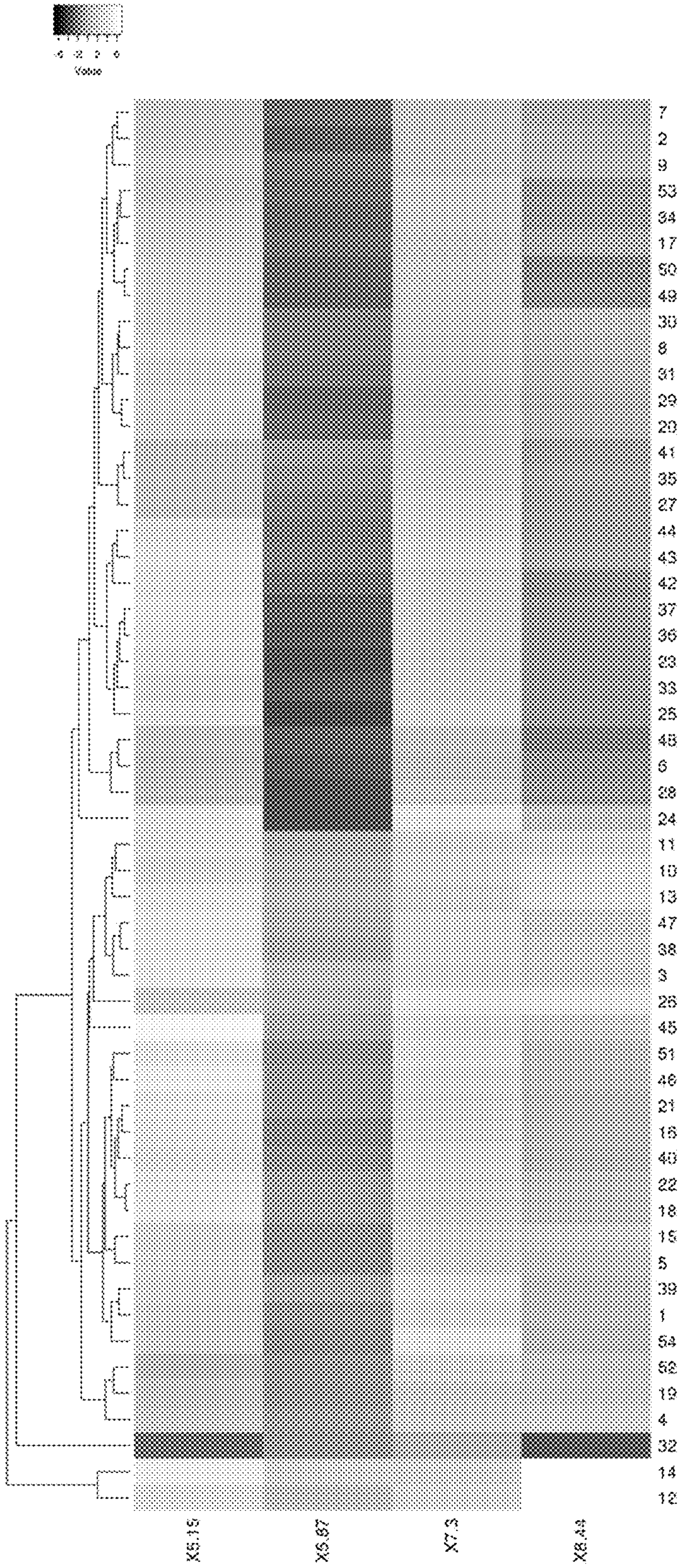
FIG. 10 shows a heatmap of prenylated products produced from selected Orf2 mutants when using Resveratrol as substrate and GPP as donor.

The amount of each prenylation product was measured by HPLC. FIG. 10 shows a heatmap of the HPLC areas of each prenylation product generated using Reservatrol as substrate and GPP as donor. Each column represents a single prenylation product and each row represents an Orf2 or Orf2 variant. Prenylation products are labeled by retention time. Enzyme variants are labeled by ID #as listed in Table 20.

Example 12: Screening of Prenyltransferase Enzymes which Synthesize an Altered Amount of Prenylated Products when Using ORA as Substrate and DMAPP as Donor Aromatic Prenyltransferase Enzymes were ordered, expressed, purified, and screened for prenylation as described in Example 1.

The prenylation reaction using ORA as substrate and DMAPP as donor produces 5 products as detected by HPLC. The respective retention times of these products are approximately 2.5, 2.77, 2.89, 4.78, and 4.96 minutes.

Table 21 provides a summary of the prenylation products produced from ORA and DMAPP, their retention times, and the hypothesized prenylation site on ORA. FIG. 26 shows the predicted chemical structures of the respective prenylation products.

TABLE 21

Predicted prenylation products of aromatic prenyltransferase enzymes when using ORA as substrate and DMAPP as donor

| Molecule ID | Substrate | Donor | Attachment Site | Retention Time |
|---|---|---|---|---|
| UNK25 | ORA | DMAPP | CO | 2.503 |
| UNK26 | ORA | DMAPP | 2-O | 4.963 |
| UNK27 | ORA | DMAPP | 4-O | 4.797 |
| UNK28 | ORA | DMAPP | 3-C | 2.765 |
| UNK29 | ORA | DMAPP | 5-C | 2.887 |

Table 22 provides a summary of the analysis performed on the enzymatic activity of the APT enzymes to produce prenylated products using ORA as substrate and DMAPP as donor. Table 22 lists the APTs analyzed as well mAU*min areas from the HPLC analysis of the reaction products.

TABLE 22

HPLC Area in mAU*min of prenylation products produced by APT enzymes when using ORA as substrate and DMAPP as donor

| ID# | APT | 2.503 | 2.765 | 2.887 | 4.797 | 4.963 |
|---|---|---|---|---|---|---|
| 1 | PB-002 | 0.806 | 0.001 | 1.51 | 0.022 | 0.013 |
| 2 | PB-005 | 0.209 | 0.341 | 0.304 | 0.01 | 0.018 |
| 3 | PB-006 | 8.57 | 0.077 | 15.442 | 0.001 | 0.211 |
| 4 | PB-064 | 8.833 | 0.62 | 1.8872 | 30.127 | 2.143 |
| 5 | PB-065 | 1.125 | 0.052 | 1.3627 | 0.0227 | 6.855 |
| 6 | PBJ | 0.021 | 0.014 | 0.0031 | 0.0033 | 0.002 |
| 7 | Orf2-A53T | 2.384 | 0.081 | 0.202 | 0.008 | 0.208 |
| 8 | Orf2-Q295F | 0.586 | 0.004 | 0.145 | 0.002 | 0.186 |

Figure 11:
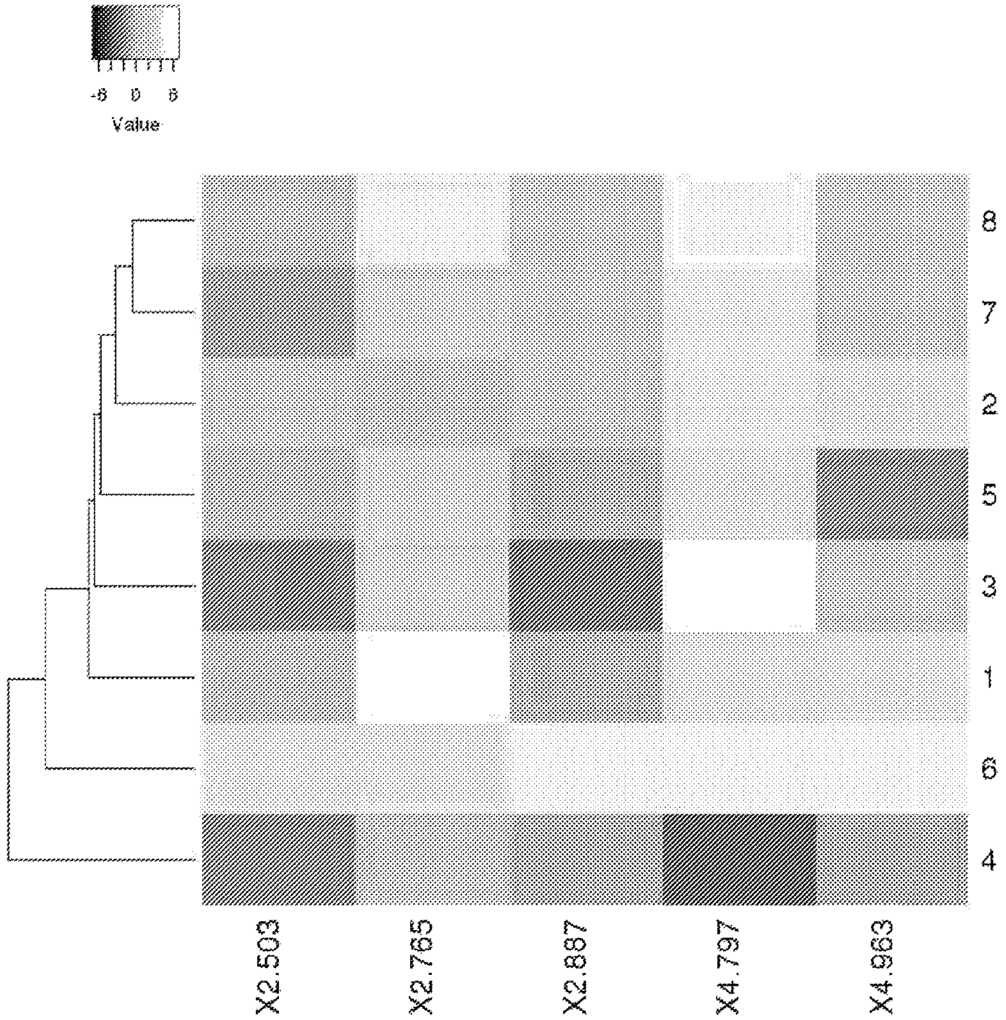
FIG. 11 shows a heatmap of prenylated products produced from prenyltransferase enzymes when using ORA as substrate and DMAPP as donor.

The amount of each prenylation product was measured by HPLC. FIG. 11 shows a heatmap of the HPLC areas of each prenylation product generated using ORA as substrate and DMAPP as donor. Each column represents a single prenylation product and each row represents an APT enzyme. Prenylation products are labeled by retention time. APTs are labeled by ID #as listed in Table 22.

Example 13: Screening of Prenyltransferase Enzymes which Synthesize an Altered Amount of Prenylated Products when Using DV as Substrate and DMAPP as Donor Aromatic Prenyltransferase Enzymes were ordered, expressed, purified, and screened for prenylation as described in Example 1.

The prenylation reaction using DV as substrate and DMAPP as donor produces 5 products as detected by HPLC. The respective retention times of these products are approximately 4.04, 4.65, 5.26, 6.83, and 7.06 minutes.

Table 23 provides a summary of the prenylation products produced from DV and DMAPP, their retention times, and the hypothesized prenylation site on DV. FIG. 27 shows the predicted chemical structures of the respective prenylation products.

TABLE 23

| Predicted prenylation products of aromatic prenyltransferase enzymes when using DV as substrate and DMAPP as donor | | | | |
|---|---|---|---|---|
| Molecule ID | Substrate | Donor | Attachment Site | Retention Time |
| UNK54 | DV | DMAPP | 1-C/5-C | 4.645 |
| UNK55 | DV | DMAPP | 2-O/4-O | 5.26 |
| UNK56 | DV | DMAPP | 3-C | 4.037 |
| UNK57 | DV | DMAPP | 5-C + 3-C | 6.833 |
| UNK58 | DV | DMAPP | 5-C + 1-C | 7.06 |

Table 24 provides a summary of the analysis performed on the enzymatic activity of the aromatic prenyltransferase enzymes to produce prenylated products using DV as substrate and DMAPP as donor. Table 24 lists the APTs analyzed as well mAU*min areas from the HPLC analysis of the reaction products.

TABLE 24

| HPLC Area in mAU*min of prenylation products produced APT enzymes when using DV as substrate and DMAPP as donor | | | | | | |
|---|---|---|---|---|---|---|
| ID# | Mutations | 4.037 | 4.645 | 5.26 | 6.833 | 7.06 |
| 1 | PB-002 | 0.249 | 0.937 | 0.002 | 0.178 | 0.017 |
| 2 | PB-005 | 0.646 | 1.4 | 2.352 | 0.321 | 5.071 |
| 3 | PB-006 | 1.814 | 1.375 | 0.001 | 4.782 | 0.717 |
| 4 | PB-064 | 0.144 | 0.7642 | 0.001 | 0.138 | 0.002 |
| 5 | PB-065 | 0.01 | 0.3027 | 0.001 | 0.122 | 0.116 |
| 6 | PBJ | 0.013 | 0.3274 | 0.001 | 0.052 | 0.39 |
| 7 | Orf2-A53T | 0.098 | 0.1293 | 0.009 | 0.18 | 0.001 |
| 8 | Orf2-Q295F | 0.002 | 0.0213 | 0.002 | 0.222 | 0.001 |

Figure 12:
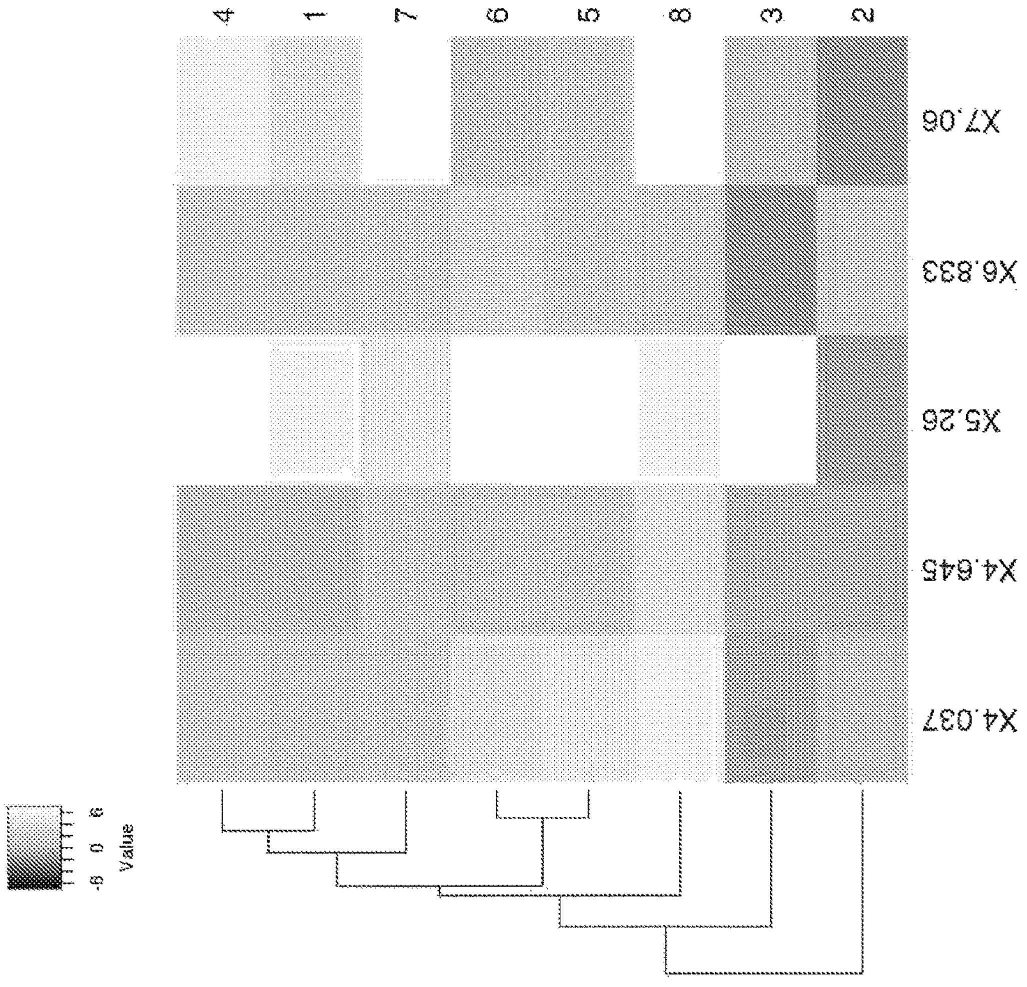
FIG. 12 shows a heatmap of prenylated products produced from prenyltransferase enzymes when using DV as substrate and DMAPP as donor.

The amount of each prenylation product was measured by HPLC. FIG. 12 shows a heatmap of the HPLC areas of each prenylation product generated using DV as substrate and DMAPP as donor. Each column represents a single prenylation product and each row represents APT enzyme. Prenylation products are labeled by retention time. APTs are labeled by ID #as listed in Table 24.

Example 14: Screening of Prenyltransferase Enzymes which Synthesize an Altered Amount of Prenylated Products when Using DV as Substrate and GPP as Donor Aromatic Prenyltransferase Enzymes were ordered, expressed, purified, and screened for prenylation as described in Example 1.

The prenylation reaction using DV as substrate and GPP as donor produces 2 products as detected by HPLC. The respective retention times of these products are approximately 6.37 and 6.88 minutes.

Table 25 provides a summary of the prenylation products produced from DV and GPP, their retention times, and the hypothesized prenylation site on DV. FIG. 28 show the predicted chemical structures of the respective prenylation products.

TABLE 25

| Predicted prenylation products of aromatic prenyltransferase enzymes when using DV as substrate and GPP as donor | | | | |
|---|---|---|---|---|
| Molecule ID | Substrate | Donor | Attachment Site | Retention Time |
| RBI-32 | DV | GPP | 3C | 6.368 |
| RBI-33 | DV | GPP | 1-C/5-C | 6.883 |

Table 26 provides a summary of the analysis performed on the enzymatic activity of the aromatic prenyltransferase enzymes to produce prenylated products using DV as substrate and GPP as donor. Table 26 lists the APTs analyzed as well mAU*min areas from the HPLC analysis of the reaction products.

TABLE 26

| HPLC Area in mAU * min of prenylation products produced by APT enzymes when using DV as substrate and GPP as donor | | | |
|---|---|---|---|
| ID# | Mutations | 6.368 | 6.883 |
| 1 | Orf2-A53Q + Y288H | 0.185 | 1.119 |
| 2 | Orf2-Q161S + V294A | 1.959 | 1.295 |
| 3 | Orf2-A53T | 1.026 | 2.371 |
| 4 | Orf2-Q295A | 0.409 | 0.851 |
| 5 | Orf2-Q295W | 0.277 | 0.711 |
| 6 | Orf2-V294A | 0.692 | 1.193 |
| 7 | Orf2-Q295F | 0.566 | 0.758 |
| 8 | Orf2-Q295H | 4.074 | 1.772 |
| 9 | Orf2-S214R | 0.130 | 0.377 |
| 10 | Orf2-WT | 0.326 | 1.077 |
| 11 | PB-005 | 0.006 | 0.086 |
| 12 | PB-064 | 0.010 | 0.059 |
| 13 | PBJ | 0.019 | 0.430 |

Figure 13:
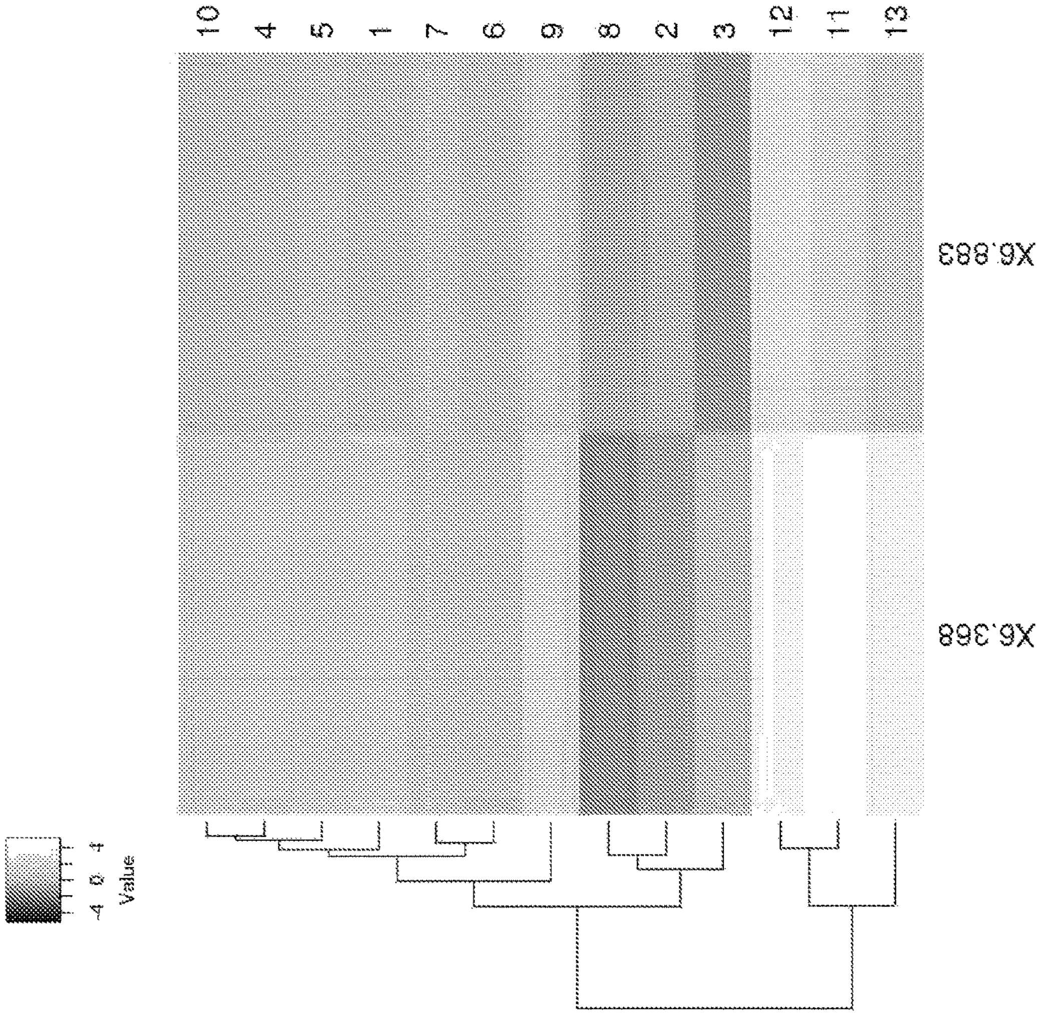
FIG. 13 shows a heatmap of prenylated products produced from prenyltransferase enzymes when using DV as substrate and GPP as donor.

The amount of each prenylation product was measured by HPLC. FIG. 13 shows a heatmap of the HPLC areas of each prenylation product generated using DV as substrate and GPP as donor. Each column represents a single prenylation product and each row represents an APT enzyme. Prenylation products are labeled by retention time. APTs are labeled by ID #as listed in Table 26.

Example 15: Screening of Prenyltransferase Enzymes which Synthesize an Altered Amount of Prenylated Products when Using DVA as Substrate and DMAPP as Donor Aromatic Prenyltransferase Enzymes were ordered, expressed, purified, and screened for prenylation as described in Example 1.

The prenylation reaction using DVA as substrate and DMAPP as donor produces 4 products as detected by HPLC. The respective retention times of these products are approximately 4.21, 4.29, 4.84, and 5.55 minutes.

Table 27 provides a summary of the prenylation products produced from DVA and DMAPP, their retention times, and the hypothesized prenylation site on DVA. FIG. 29 shows the predicted chemical structures of the respective prenylation products.

TABLE 27

| Predicted prenylation products of aromatic prenyltransferase enzymes when using DVA as substrate and DMAPP as donor | | | | |
|---|---|---|---|---|
| Molecule ID | Substrate | Donor | Attachment Site | Retention Time |
| UNK7 | DVA | DMAPP | 2-O | 5.545 |
| UNK8 | DVA | DMAPP | 4-O | 4.835 |
| UNK9 | DVA | DMAPP | 3-C | 4.213 |
| UNK10 | DVA | DMAPP | 5-C | 4.285 |

Table 28 provides a summary of the analysis performed on the enzymatic activity of the aromatic prenyltransferase enzymes to produce prenylated products using DVA as substrate and DMAPP as donor. Table 26 lists the APTs analyzed as well mAU*min areas from the HPLC analysis of the reaction products.

TABLE 28

| HPLC Area in mAU * min of prenylation products produced by APT enzymes when using DVA as substrate and DMAPP as donor | | | | | |
|---|---|---|---|---|---|
| ID# | Mutations | 4.213 | 4.285 | 4.835 | 5.545 |
| 1 | PB-002 | 0.001 | 0.531 | 0.093 | 0.2 |
| 2 | PB-005 | 0.001 | 0.312 | 0.103 | 0.195 |
| 3 | PB-006 | 0.04 | 39.357 | 0.189 | 0.196 |
| 4 | PB-064 | 0.76 | 0.1638 | 0.134 | 0.198 |
| 5 | PB-065 | 1.304 | 1.2925 | 0.126 | 0.145 |
| 6 | PBJ | 0.003 | 0.0089 | 0.005 | 0.213 |
| 7 | Orf2-A53T | 1.573 | 0.5925 | 0.163 | 0.183 |
| 8 | Orf2-Q295F | 0.114 | 1.1744 | 0.069 | 0.127 |

Figure 14:
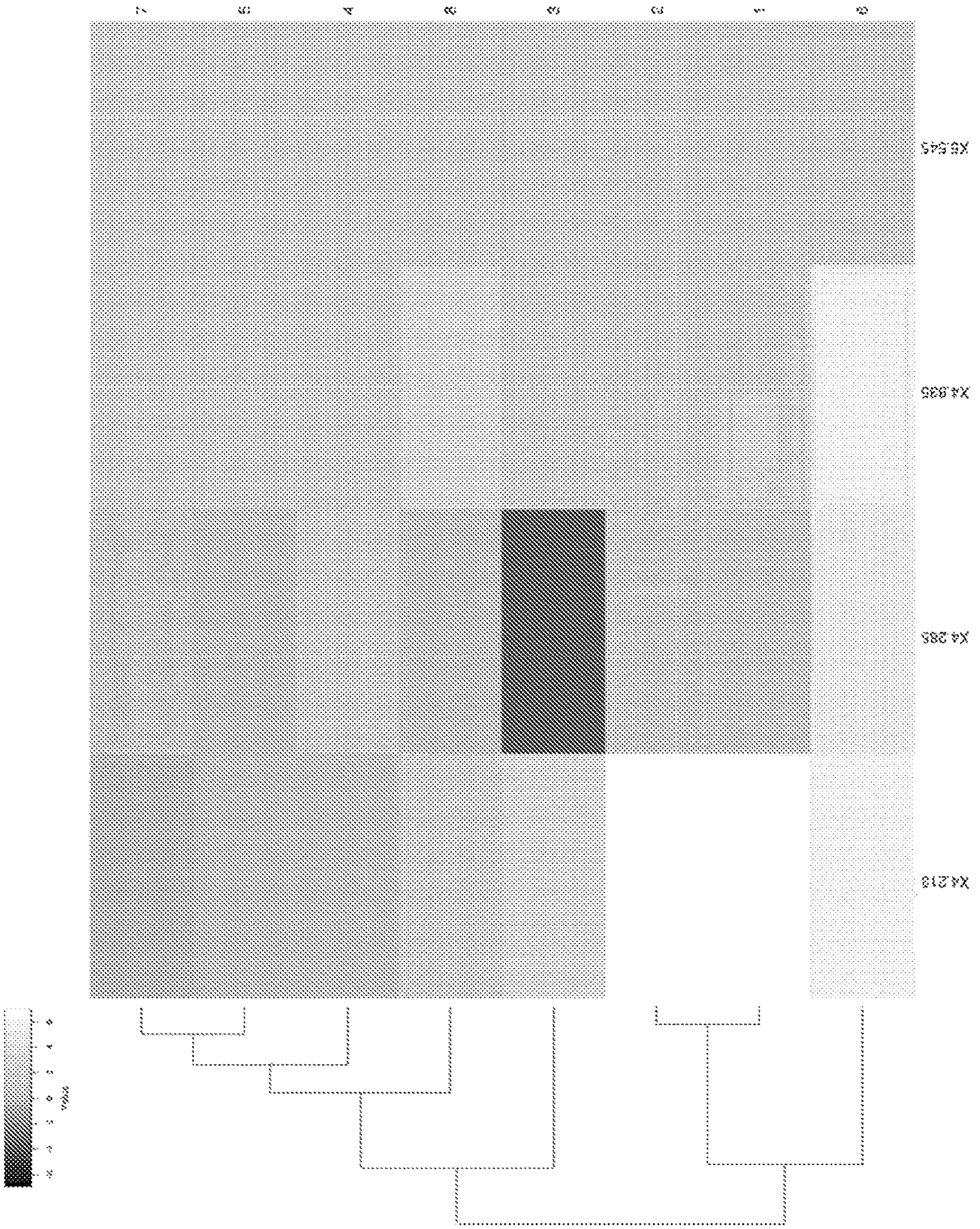
FIG. 14 shows a heatmap of prenylated products produced from prenyltransferase enzymes when using DVA as substrate and DMAPP as donor.
Figure 15:
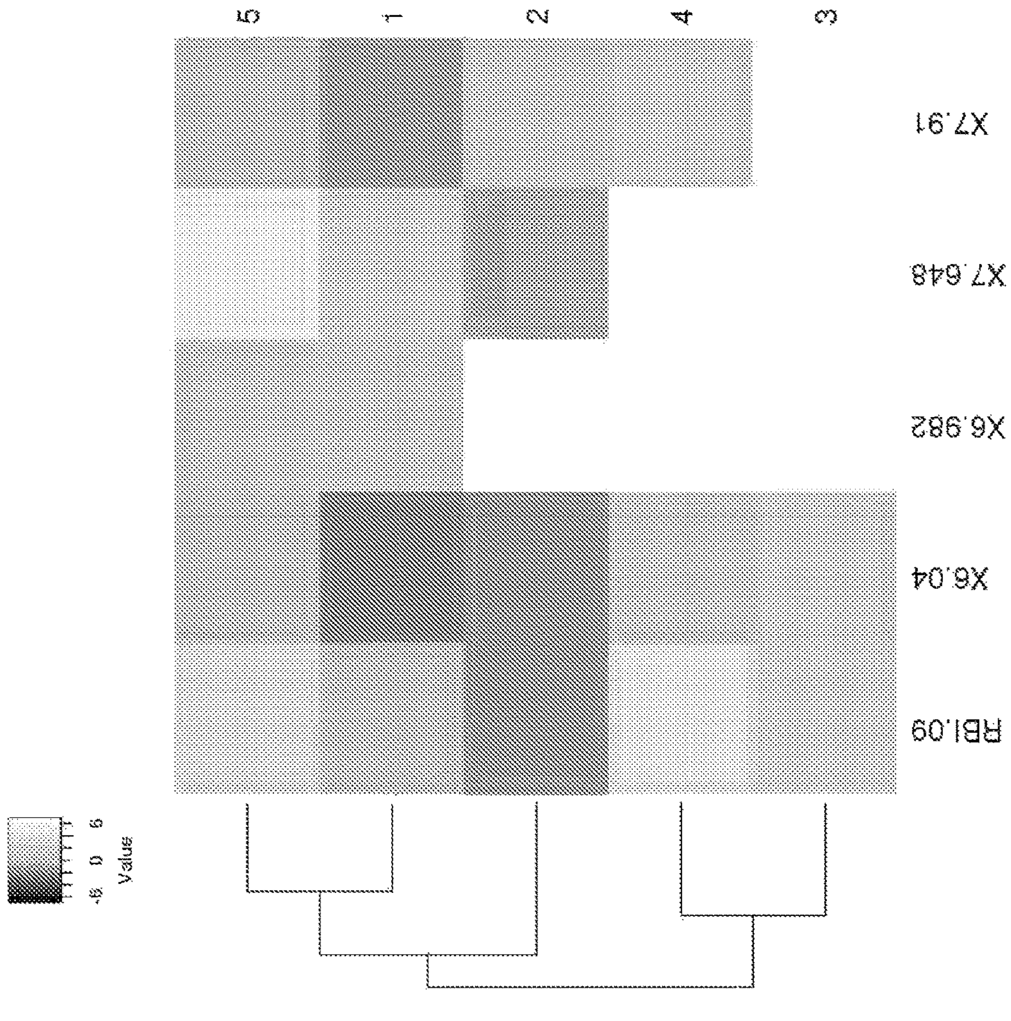
FIG. 15 shows a heatmap of prenylated products produced from prenyltransferase enzymes when using O as substrate and DMAPP as donor.

The amount of each prenylation product was measured by HPLC. FIG. 14 shows a heatmap of the HPLC areas of each prenylation product generated using DVA as substrate and DMAPP as donor. Each column represents a single prenylation product and each row represents an APT enzyme. Prenylation products are labeled by retention time. APTs are labeled by ID #as listed in Table 28.

Example 16: Screening of Prenyltransferase Enzymes which Synthesize an Altered Amount of Prenylated Products when Using O as Substrate and DMAPP as Donor Aromatic Prenyltransferase Enzymes were ordered, expressed, purified, and screened for prenylation as described in Example 1.

The prenylation reaction using O as substrate and DMAPP as donor produces 5 products as detected by HPLC. The respective retention times of these products are approximately 5.46, 6.04, 6.98, 7.65, and 7.91 minutes.

Table 29 provides a summary of the prenylation products produced from O and DMAPP, their retention times, and the hypothesized prenylation site on O. FIG. 30 shows the predicted chemical structures of the respective prenylation products.

TABLE 29

| Predicted prenylation products of aromatic prenyltransferase enzymes when using O as substrate and DMAPP as donor | | | | |
|---|---|---|---|---|
| Molecule ID | Substrate | Donor | Attachment Site | Retention Time |
| RBI-09 | O | DMAPP | 3-C | 5.46 |
| RBI-10 | O | DMAPP | 1-C/5-C | 6.04 |
| UNK16 | O | DMAPP | 2-O/4-O | 6.982 |
| RBI-12 | O | DMAPP | 1-C + 5-C | 7.91 |
| RBI-11 | O | DMAPP | 1-C + 3-C | 7.648 |

Table 30-a provides a summary of the analysis performed on the enzymatic activity of the aromatic prenyltransferase enzymes to produce prenylated products using O as substrate and DMAPP as donor. Table 30-a lists APTs analyzed as well mAU*min areas from the HPLC analysis of the reaction products.

TABLE 30-a

| HPLC Area in mAU*min of prenylation products produced by APT enzymes when using O as substrate and DMAPP as donor | | | | | | |
|---|---|---|---|---|---|---|
| ID# | Mutations | RBI-09 | 6.04 | 6.982 | 7.648 | 7.91 |
| 1 | PB-005 | 1.043 | 8.722 | 0.425 | 0.251 | 3.148 |
| 2 | PB-006 | 4.470 | 4.243 | 0.001 | 2.041 | 0.667 |
| 3 | PB-064 | 0.144 | 0.280 | 0.001 | 0.001 | 0.001 |
| 4 | PB-065 | 0.035 | 0.719 | 0.001 | 0.001 | 0.326 |
| 5 | PBJ | 0.076 | 1.003 | 0.691 | 0.011 | 1.239 |

The amount of each prenylation product was measured by HPLC. FIG. 14 shows a heatmap of the HPLC areas of each prenylation product generated using O as substrate and DMAPP as donor. Each column represents a single prenylation product and each row represents an APT enzyme. Prenylation products are labeled by retention time with the exception of RBI-09. APTs are labeled by ID #as listed in Table 30-a.

Example 17: Production of Derivative Molecules by Refeeding CBGA to Orf2 Mutants with DMAPP as a Donor CBGA produced from an aromatic prenyltransferase reaction with OA and GPP and ORF2 or Orf2 variants as described in Example 3 was purified and used as a substrate in a subsequent aromatic prenyltransferase reaction with Orf2 or Orf2 variants and DMAPP as the donor. The prenylation reaction was performed in a volume of 20 microliters and contained 20 millimolar magnesium chloride (MgCl2), 4 millimolar DMAPP, 100 millimolar HEPES buffer at a pH of 7.5, 2 millimolar CBGA, and 40 micrograms Orf2 variant protein. These reactions were incubated for 16 hours at 30° C.

The prenylation reaction using CBGA as substrate and DMAPP as donor produced a product as detected by HPLC with a retention time of approximately 9.095 minutes.

Table 30-b provides a summary of the prenylation product produced from CBGA and DMAPP, the retention times, and the hypothesized prenylation site on CBGA. FIG. 31 shows the predicted chemical structure of the prenylation product.

TABLE 30-b

| Predicted prenylation product of Orf2 enzymes when using CBGA as substrate and DMAPP as donor | | | | |
|---|---|---|---|---|
| Molecule | Prenylation Sites | Orf2Clone | Mutation | mAU * min (9.13) |
| RBI-22 | 5-C (DMAPP) + 3-C (GPP) | 33-2 | A53T | 0.0644 |
| RBI-22 | 5-C (DMAPP) + 3-C (GPP) | 122-2 | S214R | 0.0644 |
| RBI-22 | 5-C (DMAPP) + 3-C (GPP) | 56-2 | Q295F | 0.0224 |

Example 18: Production of Derivative Molecules by Refeeding RBI-04 (5-GOA) to Orf2 Mutants with DMAPP as a Donor RBI-04 (5-GOA) produced from an aromatic prenyltransferase reaction with OA and GPP using Orf2 or Orf2 variants as the prenyltransferase as described in Example 3 was purified and used as a substrate in a subsequent aromatic prenyltransferase reaction using Orf2 or Orf2 variants as the prenyltransferase. The prenylation reaction was performed in a volume of 20 microliters and contained 20 millimolar magnesium chloride (MgCl2), 4 millimolar DMAPP, 100 millimolar HEPES buffer at a pH of 7.5, 2 millimolar CBGA, and 40 micrograms Orf2 variant protein. These reactions were incubated for 16 hours at 30° C.

The prenylation reaction using RBI-04 (5-GOA) as substrate and DMAPP as donor produced a product as detected by HPLC with a retention time of approximately 9.088 minutes.

Table 31 provides a summary of the prenylation product produced from RBI-04 (5-GOA) and DMAPP, the retention times and the hypothesized prenylation site on RBI-04 (5-GOA). FIG. 32 shows the predicted chemical structure of the prenylation product.

TABLE 31

| Predicted prenylation product of Orf2 enzymes when using RBI-04 (5-GOA) as substrate and DMAPP as donor | | | |
|---|---|---|---|
| Molecule | Prenylation Sites | Mutation | mAU * min (9.088) |
| UNK36 | 5-C (GPP) + 3-C (DMAPP) | Q295F | 9.018 |

Example 19: Production of Derivative Molecules by Refeeding RBI-04 (5-GOA) to Orf2 Mutants with FPP as a Donor RBI-04 (5-GOA) produced from an aromatic prenyltransferase reaction with OA and GPP using Orf2 or Orf2 variants as the prenyltransferase as described in Example 3 was purified and used as a substrate in a subsequent aromatic prenyltransferase reaction using Orf2 or Orf2 variants as the prenyltransferase. The prenylation reaction was performed in a volume of 20 microliters and contained 20 millimolar magnesium chloride (MgCl2), 4 millimolar FPP, 100 millimolar HEPES buffer at a pH of 7.5, 2 millimolar RBI-04 (5-GOA), and 40 micrograms Orf2 variant protein. These reactions were incubated for 16 hours at 30° C.

The prenylation reaction using RBI-04 (5-GOA) as substrate and FPP as donor produced a product as detected by HPLC with a retention time of approximately 16.59 minutes.

Table 32 provides a summary of the prenylation product produced from RBI-04 (5-GOA) and FPP, the retention times and the hypothesized prenylation site on RBI-04 (5-GOA). FIG. 33 shows the predicted chemical structure of the prenylation product.

TABLE 32

| Predicted prenylation product of Orf2 enzymes when using RBI-04 (5-GOA) as substrate and FPP as donor | | | |
|---|---|---|---|
| Molecule | Prenylation Sites | Mutation | mAU * min (16.59) |
| UNK42 | 5-C (GPP) + 3-C (FPP) | Q295F | 1.747 |

Example 20: Production of Derivative Molecules by Refeeding RBI-04 (5-GOA) to Orf2 Mutants with GPP as a Donor RBI-04 (5-GOA) produced from an aromatic prenyltransferase reaction with OA and GPP using Orf2 or Orf2 variants as the prenyltransferase as described in Example 3 was purified and used as a substrate in a subsequent aromatic prenyltransferase reaction using Orf2 or Orf2 variants as the prenyltransferase. The prenylation reaction was performed in a volume of 20 microliters and contained 20 millimolar magnesium chloride (MgCl2), 2 millimolar GPP, 100 millimolar HEPES buffer at a pH of 7.5, 2 millimolar RBI-04 (5-GOA), and 20 micrograms Orf2 variant protein. These reactions were incubated for 16 hours at 30° C.

The prenylation reaction using RBI-04 (5-GOA) as substrate and GPP as donor produced a product as detected by HPLC with a retention time of approximately 11.6 minutes.

Table 33 provides a summary of the prenylation product produced from RBI-04 (5-GOA) and GPP, the retention times and the hypothesized prenylation site on RBI-04 (5-GOA). FIG. 34 shows the predicted chemical structure of the prenylation product.

TABLE 33

| Predicted prenylation product of Orf2 enzymes when using RBI-04 (5-GOA) as substrate and GPP as donor | | | | |
|---|---|---|---|---|
| Molecule | Prenylation Sites | Mutation | 5GOA | mAU * min (11.6) |
| RBI-07 | 3-C (GPP) + 5-C (GPP) | Q295A | 0.029 | 2.101 |
| RBI-07 | 3-C (GPP) + 5-C (GPP) | S214R | 0.053 | 10.7 |
| RBI-07 | 3-C (GPP) + 5-C (GPP) | A53T | 3.516 | 1.05 |

Example 21: Production of Derivative Molecules by Refeeding RBI-08 to Orf2 Mutants with DMAPP as a Donor RBI-08 produced from an aromatic prenyltransferase reaction with OA and DMAPP using Orf2 or Orf2 variants as the prenyltransferase as described in Example 2 was purified and used as a substrate in a subsequent aromatic prenyltransferase reaction using Orf2 or Orf2 variants as the prenyltransferase. The prenylation reaction was performed in a volume of 20 microliters and contained 20 millimolar magnesium chloride (MgCl2), 4 millimolar DMAPP, 100 millimolar HEPES buffer at a pH of 7.5, 1 millimolar RBI-08, and 40 micrograms Orf2 variant protein. These reactions were incubated for 16 hours at 30° C.

The prenylation reaction using RBI-08 as substrate and DMAPP as donor produced a product as detected by HPLC with a retention time of approximately 7.55 minutes.

Table 34 provides a summary of the prenylation product produced from RBI-08 and DMAPP, the retention times and the hypothesized prenylation site on RBI-08. FIG. 35 shows the predicted chemical structure of the prenylation product.

TABLE 34

Predicted prenylation product of Orf2 enzymes when using RBI-08 as substrate and DMAPP as donor

| Molecule | Prenylation Sites | Mutation | mAU * min (7.55) |
|---|---|---|---|
| RBI-18 | 5-C (DMAPP) + 3-C (DMAPP) | S214R | 0.1356 |
| RBI-18 | 5-C (DMAPP) + 3-C (DMAPP) | Q295F | 1.3375 |
| RBI-18 | 5-C (DMAPP) + 3-C (DMAPP) | A53T | 7.9273 |

Example 22: Production of Derivative Molecules by Refeeding RBI-08 to Orf2 Mutants with GPP as a Donor RBI-08 produced from an aromatic prenyltransferase reaction with OA and DMAPP using Orf2 or Orf2 variants as the prenyltransferase as described in Example 2 was purified and used as a substrate in a subsequent aromatic prenyltransferase reaction using Orf2 or Orf2 variants as the prenyltransferase The prenylation reaction was performed in a volume of 20 microliters and contained 20 millimolar magnesium chloride (MgCl2), 4 millimolar GPP, 100 millimolar HEPES buffer at a pH of 7.5, 2 millimolar RBI-08, and 40 micrograms Orf2 variant protein. These reactions were incubated for 16 hours at 30° C.

The prenylation reaction using RBI-08 as substrate and GPP as donor produced 2 products as detected by HPLC with retention times of approximately 8.22 and 9.1 minutes.

Table 35 provides a summary of the prenylation products produced from RBI-08 and GPP, the retention times and the hypothesized prenylation sites on RBI-08. FIG. 36 shows the predicted chemical structures of the prenylation products.

TABLE 35

Predicted prenylation product of Orf2 enzymes when using RBI-09 as substrate and GPP as donor

| Molecule | Prenylation Sites | Mutation | mAU * min | Retention Time |
|---|---|---|---|---|
| UNK38 | CO (GPP) + 3-C (DMAPP) | A53T | 6.4738 | 8.22 |
| UNK38 | CO (GPP) + 3-C (DMAPP) | S214R | 0.0039 | 8.22 |
| UNK38 | CO (GPP) + 3-C (DMAPP) | Q295F | 5.9266 | 8.22 |
| UNK36 | 5-C (GPP) + 3-C (DMAPP) | A53T | 2.5133 | 9.1 |
| UNK36 | 5-C (GPP) + 3-C (DMAPP) | S214R | 0.0276 | 9.1 |
| UNK36 | 5-C (GPP) + 3-C (DMAPP) | Q295F | 1.6517 | 9.1 |

Example 23: Production of Derivative Molecules by Refeeding RBI-09 to Orf2 Mutants with GPP as a Donor RBI-09 produced from an aromatic prenyltransferase reaction with 0 and DMAPP as described in Example 16 was purified and used as a substrate in a subsequent aromatic prenyltransferase reaction using Orf2 or Orf2 variants and GPP as the donor. The first prenyltransferase reaction can include any of the prenyltransferases listed in Example 16. The prenylation reaction was performed in a volume of 20 microliters and contained 20 millimolar magnesium chloride (MgCl2), 4 millimolar GPP, 100 millimolar HEPES buffer at a pH of 7.5, 2 millimolar RBI-09, and 40 micrograms Orf2 variant protein. These reactions were incubated for 16 hours at 30° C.

The prenylation reaction using RBI-09 as substrate and GPP as donor produced a product as detected by HPLC with a retention time of approximately 9.26 minutes.

Table 36 provides a summary of the prenylation product produced from RBI-09 and GPP, the retention times and the hypothesized prenylation sites on RBI-09. FIG. 37 shows the predicted chemical structures of the prenylation products.

TABLE 36

Predicted prenylation product of Orf2 enzymes when using RBI-09 as substrate and GPP as donor

| Molecule | Prenylation Sites | Mutation | mAU*min (9.26) |
|---|---|---|---|
| UNK40 | 5-C (GPP) + 3-C (DMAPP) | Q295Y | 5.6977 |

Example 24: Production of Derivative Molecules by Refeeding RBI-10 to APT Enzymes with DMAPP as a Donor RBI-010 produced from an aromatic prenyltransferase reaction with 0 and DMAPP as described in Example 16 was purified and used as a substrate in a subsequent aromatic prenyltransferase reaction using PB-005 or PB-006 as the prenyltransferase and DMAPP as the donor. The prenylation reaction was performed in a volume of 20 microliters and contained 20 millimolar magnesium chloride (MgCl2), 2 millimolar DMAPP, 100 millimolar HEPES buffer at a pH of 7.5, 2 millimolar RBI-10, and 20 micrograms APT protein. Two APT enzymes were tested. These reactions were incubated for 16 hours at 30° C.

The prenylation reaction using RBI-10 as substrate and DMAPP as donor produced 2 product as detected by HPLC with a retention times of approximately 7.65 and 7.91 minutes.

Table 37 provides a summary of the prenylation products produced from RBI-10 and DMAPP, the retention times and the hypothesized prenylation sites on RBI-10. FIG. 38 shows the predicted chemical structures of the prenylation products.

TABLE 37

| Predicted prenylation product of Orf2 enzymes when using RBI-10 as substrate and DMAPP as donor | | | | |
|---|---|---|---|---|
| Molecule | Prenylation Sites | APT | mAU * min | Retention Time |
| RBI-11 | 1-C (DMAPP) + 3-C (DMAPP) | PB-005 | 0.5236 | 7.65 |
| RBI-11 | 1-C (DMAPP) + 3-C (DMAPP) | PB-006 | 7.401 | 7.65 |
| RBI-12 | 1-C (DMAPP) + 5-C (DMAPP) | PB-005 | 4.7233 | 7.91 |
| RBI-12 | 1-C (DMAPP) + 5-C (DMAPP) | PB-006 | 1.208 | 7.91 |

Example 25: Production of Derivative Molecules by Refeeding RBI-10 to APT Enzymes with FPP as a Donor RBI-010 produced from an aromatic prenyltransferase reaction with 0 and DMAPP as described in Example 16 was purified and used as a substrate in a subsequent aromatic prenyltransferase reaction using PB-005 or Orf2 variants as the prenyltransferase and FPP as the donor. The prenylation reaction was performed in a volume of 20 microliters and contained 20 millimolar magnesium chloride (MgCl2), 4 millimolar FPP, 100 millimolar HEPES buffer at a pH of 7.5, 2 millimolar RBI-10, and 40 micrograms APT protein. Two APT enzymes were tested. These reactions were incubated for 16 hours at 30° C.

The prenylation reaction using RBI-10 as substrate and FPP as donor produced 2 products as detected by HPLC with a retention times of approximately 11.8 and 12.9 minutes.

Table 38 provides a summary of the prenylation products produced from RBI-10 and FPP, the retention times and the hypothesized prenylation sites on RBI-10. FIG. 39 shows the predicted chemical structures of the prenylation products.

TABLE 38

| Predicted prenylation product of Orf2 enzymes when using RBI-10 as substrate and FPP as donor | | | | |
|---|---|---|---|---|
| Molecule | Prenylation Sites | APT | mAU * Min | Retention Time |
| UNK44 | 5-C (DMAPP) + 3-C (FPP) | PB-005 | 0.5236 | 11.8 |
| UNK44 | 5-C (DMAPP) + 3-C (FPP) | Orf2-Q295Y | 7.401 | 11.8 |
| UNK45 | 5-C (DMAPP) + 1-C(FPP) | PB-005 | 4.7233 | 12.9 |
| UNK45 | 5-C (DMAPP) + 1-C(FPP) | Orf2-Q295Y | 1.208 | 12.9 |

Example 26: Production of Derivative Molecules by Refeeding RBI-10 to Orf2 Variant Enzymes with GPP as a Donor RBI-010 produced from an aromatic prenyltransferase reaction with 0 and DMAPP as described in Example 16 was purified and used as a substrate in a subsequent aromatic prenyltransferase reaction using Orf2 variants as the prenyltransferase and GPP as the donor. The prenylation reaction was performed in a volume of 20 microliters and contained 20 millimolar magnesium chloride (MgCl2), 4 millimolar GPP, 100 millimolar HEPES buffer at a pH of 7.5, 2 millimolar RBI-10, and 40 micrograms Orf2 Variant protein. These reactions were incubated for 16 hours at 30° C.

The prenylation reaction using RBI-10 as substrate and GPP as donor produced 2 products as detected by HPLC with a retention times of approximately 9.2 and 9.7 minutes.

Table 39 provides a summary of the prenylation products produced from RBI-10 and GPP, the retention times and the hypothesized prenylation sites on RBI-10. FIG. 40 shows the predicted chemical structures of the prenylation products.

TABLE 39

| Predicted prenylation product of Orf2 enzymes when using RBI-10 as substrate and GPP as donor | | | | |
|---|---|---|---|---|
| Molecule | Prenylation Sites | Mutation | mAU * min | Retention Time |
| UNK41 | 5-C (DMAPP) + 3-C (GPP) | Q295Y | 14.558 | 9.2 |
| UNK41 | 5-C (DMAPP) + 3-C (GPP) | S214R | 8.9769 | 9.2 |
| UNK66 | 5-C (DMAPP) + 1-C (GPP) | Q295Y | 1.4035 | 9.7 |
| UNK66 | 5-C (DMAPP) + 1-C (GPP) | S214R | 1.2629 | 9.7 |

Example 27: Production of Derivative Molecules by Refeeding RBI-12 to Orf2 Variant Enzymes with GPP as a Donor RBI-12 produced from an aromatic prenyltransferase reaction as described in Example 16 (1 reactions) or Example 24 (2 sequential reactions) was purified and used as a substrate in a subsequent aromatic prenyltransferase reaction using Orf2 variants as the prenyltransferase and GPP as the donor. The prenylation reaction was performed in a volume of 20 microliters and contained 20 millimolar magnesium chloride (MgCl2), 4 millimolar GPP, 100 millimolar HEPES buffer at a pH of 7.5, 2 millimolar RBI-12, and 40 micrograms Orf2 Variant protein. These reactions were incubated for 16 hours at 30° C.

The prenylation reaction using RBI-12 as substrate and GPP as donor produced a product as detected by HPLC with a retention time of approximately 11.27 minutes.

Table 40 provides a summary of the prenylation products produced from RBI-12 and GPP, the retention times and the hypothesized prenylation sites on RBI-12. FIG. 41 shows the predicted chemical structures of the prenylation products.

TABLE 40

| Predicted prenylation product of Orf2 enzymes when using RBI-12 as substrate and GPP as donor | | | |
|---|---|---|---|
| Molecule | Prenylation Sites | Mutation | mAU * min (11.27) |
| UNK67 | 5-C (DMAPP) + 1-C (DMAPP) + 3-C (GPP) | Q295Y | 9.4062 |
| UNK67 | 5-C (DMAPP) + 1-C (DMAPP) + 3-C (GPP) | S214R | 2.0624 |
| UNK67 | 5-C (DMAPP) + 1-C (DMAPP) + 3-C (GPP) | A53T | 2.5475 |

Example 28: Production of Derivative Molecules by Refeeding RBI-03 to APT Enzymes with DMAPP as a Donor RBI-03 produced from an aromatic prenyltransferase reaction with 0 as substrate and GPP as donor as described in Example 5 was purified and used as a substrate in a subsequent aromatic prenyltransferase reaction with PB-005 as the prenyltransferase and GPP as the donor. The prenylation reaction was performed in a volume of 20 microliters and contained 20 millimolar magnesium chloride (MgCl2), 4 millimolar DMAPP, 100 millimolar HEPES buffer at a pH of 7.5, 2 millimolar RBI-03, and 40 micrograms APT enzyme. These reactions were incubated for 16 hours at 30° C.

The prenylation reaction using RBI-03 as substrate and DMAPP as donor produced 2 products as detected by HPLC with retention times of approximately 9.3 and 9.7 minutes.

Table 41 provides a summary of the prenylation products produced from RBI-03 and DMAPP, the retention times and the hypothesized prenylation sites on RBI-03. FIG. 42 shows the predicted chemical structures of the prenylation products.

TABLE 41

| Predicted prenylation product of APT enzymes when using RBI-03 as substrate and DMAPP as donor | | | | |
|---|---|---|---|---|
| Molecule | Prenylation Sites | APT | mAU*min | Retention Time |
| UNK40 | 5-C (GPP) + 3-C (DMAPP) | PB005 | 0.1765 | 9.26 |
| UNK66 | 5-C (DMAPP) + 1-C (GPP) | PB005 | 1.587 | 9.7 |

Example 29: Screening of Prenyltransferase Enzymes which Synthesize an Altered Amount of Prenylated Products when Using O as Substrate and FPP as Donor Aromatic Prenyltransferase Enzymes were ordered, expressed, purified, and screened for prenylation as described in Example 1.

The prenylation reaction using O as substrate and FPP as donor produces 3 products as detected by HPLC. The respective retention times of these products are approximately 8.52, 9.57, and 10.94 minutes.

Table 42 provides a summary of the prenylation products produced from O and FPP, their retention times, and the hypothesized prenylation site on O. FIG. 43 shows the predicted chemical structures of the respective prenylation products.

TABLE 42

| Predicted prenylation products of aromatic prenyltransferase enzymes when using O as substrate and FPP as donor | | | | |
|---|---|---|---|---|
| Molecule ID | Substrate | Donor | Attachment Site | Retention Time |
| RBI-15 | O | FPP | 1-C/5-C | 9.57 |
| UNK18 | O | FPP | 4-O/2-O | 10.94 |
| UNK19 | O | FPP | 3-C | 8.52 |

Table 43 provides a summary of the analysis performed on the enzymatic activity of the aromatic prenyltransferase enzymes to produce prenylated products using O as substrate and FPP as donor. Table 43 lists APTs analyzed as well mAU*min areas from the HPLC analysis of the reaction products.

TABLE 43

| HPLC Area in mAU*min of prenylation products produced by APT enzymes when using O as substrate and FPP as donor | | | | |
|---|---|---|---|---|
| | Mutations | UNK19 (8.52) | RBI-15 (9.57) | UNK18 (10.94) |
| 1 | PB-005 | 0.473 | 0.393 | 0.219 |
| 2 | Q295Y | 0.272 | 0.259 | 0.177 |

Example 30: Screening of Prenyltransferase Enzymes which Synthesize an Altered Amount of Prenylated Products when Using ORA as Substrate and FPP as Donor Aromatic Prenyltransferase Enzymes were ordered, expressed, purified, and screened for prenylation as described in Example 1.

The prenylation reaction using ORA as substrate and FPP as donor produces 3 products as detected by HPLC. The respective retention times of these products are approximately 7.44, 7.98, and 8.96 minutes.

Table 44 provides a summary of the prenylation products produced from ORA and FPP, their retention times, and the hypothesized prenylation site on ORA. FIG. 44 shows the predicted chemical structures of the respective prenylation products.

TABLE 44

| Predicted prenylation products of aromatic prenyltransferase enzymes when using ORA as substrate and FPP as donor | | | | |
|---|---|---|---|---|
| Molecule ID | Substrate | Donor | Attachment Site | Retention Time |
| UNK33 | ORA | FPP | 3-C | 7.44 |
| UNK34 | ORA | FPP | 5-C | 7.98 |
| UNK31 | ORA | FPP | 2-O | 8.44 |

Table 45 provides a summary of the analysis performed on the enzymatic activity of the aromatic prenyltransferase enzymes to produce prenylated products using ORA as substrate and FPP as donor. Table 45 lists APTs analyzed as well mAU*min areas from the HPLC analysis of the reaction products.

TABLE 45

| HPLC Area in mAU*min of prenylation products produced by APT enzymes when using ORA as substrate and FPP as donor | | | | |
|---|---|---|---|---|
| ID# | Mutations | 7.44 | 7.98 | 8.96 |
| 1 | Orf2-A53T | 4.940 | 1.264 | 0.547 |
| 2 | Orf2-Q295F | 0.822 | 0.162 | 0.157 |

Example 31: Screening of Prenyltransferase Enzymes which Synthesize an Altered Amount of Prenylated Products when Using OA as Substrate and GGPP as Donor Aromatic Prenyltransferase Enzymes were ordered, expressed, purified, and screened for prenylation as described in Example 1.

The prenylation reaction using OA as substrate and GGPP as donor produces 2 products as detected by HPLC. The respective retention times of these products are approximately 10.29 and 11.18 minutes.

Table 46 provides a summary of the prenylation products produced from OA and GGPP, their retention times, and the hypothesized prenylation site on OA. FIG. 45 shows the predicted chemical structures of the respective prenylation products.

TABLE 46

| Predicted prenylation products of aromatic prenyltransferase enzymes when using OA as substrate and GGPP as donor | | | | |
|---|---|---|---|---|
| Molecule ID | Substrate | Donor | Attachment Site | Retention Time |
| UNK60 | OA | GGPP | 3C | 10.29 |
| UNK61 | OA | GGPP | 5-C | 11.18 |

Table 47 provides a summary of the analysis performed on the enzymatic activity of the aromatic prenyltransferase enzymes to produce prenylated products using OA as substrate and GGPP as donor. Table 47 lists APTs analyzed as well mAU*min areas from the HPLC analysis of the reaction products.

TABLE 47

| HPLC Area in mAU*min of prenylation products produced by APT enzymes when using OA as substrate and GGPP as donor | | | |
|---|---|---|---|
| ID# | Mutations | 10.29 | 11.18 |
| 1 | Orf2-A53T | 0.059 | 0.233 |
| 2 | Orf2-Q295F | 0.607 | 0.069 |

Example 32: Screening of Prenyltransferase Enzymes which Synthesize an Altered Amount of Prenylated Products when Using ORA as Substrate and GGPP as Donor Aromatic Prenyltransferase Enzymes were ordered, expressed, purified, and screened for prenylation as described in Example 1.

The prenylation reaction using ORA as substrate and GGPP as donor produces 2 products as detected by HPLC. The respective retention times of these products are approximately 8.98 and 9.06 minutes.

Table 48 provides a summary of the prenylation products produced from ORA and GGPP, their retention times, and the hypothesized prenylation site on ORA. FIG. 46 shows the predicted chemical structures of the respective prenylation products.

TABLE 48

Predicted prenylation products of aromatic prenyltransferase enzymes when using ORA as substrate and GGPP as donor

| Molecule ID | Substrate | Donor | Attachment Site | Retention Time |
|---|---|---|---|---|
| UNK62 | ORA | GGPP | 3C | 8.98 |
| UNK63 | ORA | GGPP | 5-C | 9.06 |

Table 49 provides a summary of the analysis performed on the enzymatic activity of the aromatic prenyltransferase enzymes to produce prenylated products using ORA as substrate and GGPP as donor. Table 49 lists APTs analyzed as well mAU*min areas from the HPLC analysis of the reaction products.

TABLE 49

HPLC Area in mAU*min of prenylation products produced by APT enzymes when using OA as substrate and GGPP as donor

| ID# | Mutations | 8.98 | 9.06 |
|---|---|---|---|
| 1 | Orf2-A53T | 0.094 | 0.253 |
| 2 | Orf2-Q295F | 0.071 | 0.069 |

Example 33: Screening of Prenyltransferase Enzymes which Synthesize an Altered Amount of Prenylated Products when Using DVA as Substrate and GGPP as Donor Aromatic Prenyltransferase Enzymes were ordered, expressed, purified, and screened for prenylation as described in Example 1.

The prenylation reaction using DVA as substrate and GGPP as donor produces 2 products as detected by HPLC. The respective retention times of these products are approximately 9.48 and 9.87 minutes.

Table 50 provides a summary of the prenylation products produced from DVA and GGPP, their retention times, and the hypothesized prenylation site on DVA. FIG. 47 shows the predicted chemical structures of the respective prenylation products.

TABLE 50

Predicted prenylation products of aromatic prenyltransferase enzymes when using ORA as substrate and GGPP as donor

| Molecule ID | Substrate | Donor | Attachment Site | Retention Time |
|---|---|---|---|---|
| UNK64 | DVA | GGPP | 3C | 9.48 |
| UNK65 | DVA | GGPP | 5-C | 9.87 |

Table 51 provides a summary of the analysis performed on the enzymatic activity of the aromatic prenyltransferase enzymes to produce prenylated products using DVA as substrate and GGPP as donor. Table 51 lists APTs analyzed as well mAU*min areas from the HPLC analysis of the reaction products.

TABLE 51

HPLC Area in mAU*min of prenylation products produced by APT enzymes when using DVA as substrate and GGPP as donor

| ID# | Mutations | 9.48 | 9.87 |
|---|---|---|---|
| 1 | Orf2-A53T | 0.063 | 0.440 |
| 2 | Orf2-Q295F | 0.350 | 0.064 |

Example 34—Generation of ORF2 Variants which Synthesize an Altered Amount of CBFA and/or 5-FOA, Compared to WT ORF2

Table 52 provides a summary of the analysis performed on the enzymatic activity of the ORF2 variants to produce CBFA and 5-FOA using Olivetolic Acid (OA) as substrate and FPP as donor. Table 52 lists the mutations within each of the tripleton mutants as well the nMol of CBFA produced, nMol of 5-FOA produced, total prenylated products produced (nMol of CBFA+5-FOA), % CBFA within total prenylated products (nMol of CBFA/[nMol of CBFA+5-FOA]), % enzymatic activity (total prenylated products produced by a mutant/total prenylated products produced by wild-type ORF2), CBFA production (% CBFA among total prenylated products*% enzymatic activity), and %5-FOA within prenylated products (nMol of 5-FOA/[nMol of CBFA+5-FOA]) for each of the ORF2 variants.

TABLE 52

Analysis of ORF2 mutants and WT ORF2 based on production of CBFA from OA and FPP

| CLONE | Mutations | nMol CBFA | nMol 5-FOA | Total Products | % CBFA | % Activity | CBFA Production Potential | % 5-FOA |
|---|---|---|---|---|---|---|---|---|
| WT | WT | 0.055962156 | 0.364360073 | 0.42032223 | 13.31% | 100.00% | 0.133141082 | 86.7% |
| H03 | V24_A17T_F213M_S214R | 0.297527669 | 0.012775302 | 0.310302971 | 95.88% | 58.75% | 0.563316386 | 4.1% |
| A4 | V25_L219F_V294N_Q295A | 0.213539807 | 0.066199295 | 0.279739102 | 76.34% | 66.55% | 0.508038338 | 23.7% |
| C6 | V43_Q161A_M162F_Q295A | 0.120001785 | 0.009713453 | 0.129715238 | 92.51% | 30.86% | 0.285499497 | 7.5% |
| C5 | V35_A53Q_S177Y_Y288H | 0.111656551 | 0.089215955 | 0.200872507 | 55.59% | 47.79% | 0.265645125 | 44.4% |
| A9 | V65_V49A_Q161S_V294A | 0.083050696 | 0.040754271 | 0.123804967 | 67.08% | 29.45% | 0.19758816 | 32.9% |
| H9 | V72_E112G_G205M_L298W | 0.120715816 | 3.345756699 | 3.466472515 | 3.48% | 338.13% | 0.117748184 | 96.5% |
| C11 | V83_E112D_L219F_V294F | 0.049223492 | 1.057816162 | 1.107039654 | 4.45% | 263.38% | 0.117108942 | 95.6% |
| H2 | V16_A53Q_S177W_L219F | 0.118930739 | 0.129125578 | 0.248056317 | 47.95% | 24.20% | 0.116006991 | 52.1% |
| D12 | V92_A53T_E112D_G205M | 0.112995359 | 2.775408071 | 2.888403429 | 3.91% | 281.74% | 0.110217524 | 96.1% |
| D4 | V28_A53T_D166E_Q295W | 0.045073188 | 0.208522499 | 0.253595687 | 17.77% | 60.33% | 0.107234843 | 82.2% |
| A2 | V9_Q38G_E112D_F123H | 0.043779007 | 1.308359905 | 1.352138912 | 3.24% | 321.69% | 0.104155822 | 96.8% |
| G12 | V95_A17T_Q161W_A232S | 0.090994288 | 0.022488756 | 0.113483043 | 80.18% | 11.07% | 0.088757319 | 19.8% |

TABLE 52-continued

Analysis of ORF2 mutants and WT ORF2 based on production of CBFA from OA and FPP

| CLONE | Mutations | nMol CBFA | nMol 5-FOA | Total Products | % CBFA | % Activity | CBFA Production Potential | % 5-FOA |
|---|---|---|---|---|---|---|---|---|
| F9 | V70_Q38G_D166E_Q295A | 0.083853981 | 0.261946492 | 0.345800472 | 24.25% | 33.73% | 0.081792546 | 75.8% |
| A5 | V33_A17T_C25V_E112G | 0.030569439 | 0.172308212 | 0.202877652 | 15.07% | 48.27% | 0.072728581 | 84.9% |
| D11 | V84_F123H_L174V_S177E | 0.05315066 | 0.163122664 | 0.216273324 | 24.58% | 21.10% | 0.051844025 | 75.4% |
| E9 | V69_A53T_M106E_Q161S | 0.051544091 | 0.182338408 | 0.2338825 | 22.04% | 22.81% | 0.050276951 | 78.0% |
| G3 | V23_L219F_Y283L_L298W | 0.048777222 | 1.532825137 | 1.581602359 | 3.08% | 154.27% | 0.047578102 | 96.9% |
| B12 | V90_A17T_F123W_L298A | 0.018966441 | 0.074645776 | 0.093612216 | 20.26% | 22.27% | 0.045123572 | 79.7% |
| G08 | V63_F123W_M162F_C209G | 0.012540164 | 0.00316743 | 0.015707595 | 79.84% | 5.16% | 0.041205063 | 20.2% |
| G11 | V87_S177W_Y288H_V294N | 0.025660478 | 0.00422324 | 0.029883719 | 85.87% | 2.91% | 0.025029651 | 14.1% |
| G9 | V71_M106E_G205L_C209G | 0.025526598 | 0.004117659 | 0.029644257 | 86.11% | 2.89% | 0.024899061 | 13.9% |
| H5 | V40_S177E_S214R_R228E | 0.02418779 | 0.000211162 | 0.024398952 | 99.13% | 2.38% | 0.023593167 | 0.9% |
| A3 | V17_V49L_F123A_Y283L | 0.00941628 | 0.011825073 | 0.021241353 | 44.33% | 5.05% | 0.022402527 | 55.7% |
| A7 | V49_G205L_R228E_C230N | 0.009059265 | 0.004856727 | 0.013915991 | 65.10% | 3.31% | 0.021553142 | 34.9% |
| A8 | V57_C25V_A232S_V271E | 0.009059265 | 0.004856727 | 0.013915991 | 65.10% | 3.31% | 0.021553142 | 34.9% |
| A10 | V73_V49S_K118Q_S177E | 0.008389861 | 0.039381718 | 0.047771578 | 17.56% | 11.37% | 0.019960545 | 82.4% |
| B8 | V58_K118Q_L174V_R228Q | 0.008389861 | 0.003589754 | 0.011979615 | 70.03% | 2.85% | 0.019960545 | 30.0% |
| B10 | V74_M106E_Y121W_D166E | 0.007854338 | 0.003589754 | 0.011444092 | 68.63% | 2.72% | 0.018686468 | 31.4% |
| C8 | V59_V49S_S214G_V294A | 0.007765084 | 0.053529573 | 0.061294657 | 12.67% | 14.58% | 0.018474121 | 87.3% |
| H4 | V32_M162A_C209G_Y288H | 0.018163156 | 0.00517347 | 0.023336626 | 77.83% | 2.28% | 0.01771664 | 22.2% |
| H7 | V56_F123A_M162F_S214G | 0.01767226 | 0.453048124 | 0.470720384 | 3.75% | 45.91% | 0.017237812 | 96.2% |
| D6 | V44_A53E_Q161A_V294N | 0.00709568 | 0.030090589 | 0.037186269 | 19.08% | 8.85% | 0.016881525 | 80.9% |
| B4 | V26_A53E_A108G_K118N | 0.00709568 | 0.004012078 | 0.011107759 | 63.88% | 2.64% | 0.016881525 | 36.1% |
| G5 | V39_A53T_K118N_S214F | 0.016467333 | 0.004434403 | 0.020901736 | 78.78% | 2.04% | 0.016062506 | 21.2% |
| D8 | V60_E112D_K119A_N173D | 0.016065691 | 0.002745106 | 0.018810797 | 85.41% | 1.83% | 0.015670738 | 14.6% |
| F10 | V78_K119D_Q161W_L298Q | 0.014905391 | 0.008129738 | 0.023035129 | 64.71% | 2.25% | 0.014538962 | 35.3% |
| B2 | V10_V49A_S177Y_C209G | 0.006024634 | 0.005279051 | 0.011303685 | 53.30% | 2.69% | 0.01433337 | 46.7% |
| H6 | V48_V49L_E112D_G286E | 0.014548376 | 0.002428363 | 0.016976739 | 85.70% | 1.66% | 0.014190724 | 14.3% |
| C10 | V75_A53Q_L274V_Q295A | 0.005890753 | 0.004962308 | 0.010853061 | 54.28% | 2.58% | 0.014014851 | 45.7% |
| B6 | V42_D166E_S177Y_S214F | 0.005489111 | 0.003061849 | 0.00855096 | 64.19% | 2.03% | 0.013059293 | 35.8% |
| D9 | V68_K118N_C209G_R228Q | 0.013209568 | 0.003273011 | 0.016482579 | 80.14% | 1.61% | 0.012884829 | 19.9% |
| A12 | V89_Y121W_S177Y_G286E | 0.00535523 | 0.000844648 | 0.006199878 | 86.38% | 1.48% | 0.012740773 | 13.6% |
| F8 | V62_A53T_N173D_S214R | 0.012540164 | 0.000422324 | 0.012962488 | 96.74% | 1.26% | 0.012231882 | 3.3% |
| A11 | V8l_V49L_D166E_L274V | 0.005132096 | 0.001372553 | 0.006504649 | 78.90% | 1.55% | 0.012209908 | 21.1% |
| D3 | V20_D227E_C230N_Q295W | 0.005132096 | 0.007390671 | 0.012522767 | 40.98% | 2.98% | 0.012209908 | 59.0% |
| C1 | V3_V49S_M162A_Y283L | 0.005087469 | 0.18360538 | 0.188692849 | 2.70% | 44.89% | 0.012103735 | 97.3% |
| D8 | V60_E112D_K119A_N173D | 0.012406283 | 0.003589754 | 0.015996038 | 77.56% | 1.56% | 0.012101292 | 22.4% |
| H8 | V64_M106E_M162A_Y216A | 0.01187076 | 0.007073928 | 0.018944688 | 62.66% | 1.85% | 0.011578934 | 37.3% |
| C3 | V19_V49L_S214R_V271E | 0.004685826 | 0.00211162 | 0.006797447 | 68.94% | 1.62% | 0.011148177 | 31.1% |
| D05 | V36_F123H_L274V_L298A | 0.005622992 | 0.034313829 | 0.039936821 | 14.08% | 7.56% | 0.010646147 | 85.9% |
| B5 | V34_A53Q_Y121W_A232S | 0.004462692 | 0.002217201 | 0.006679893 | 66.81% | 1.59% | 0.010617311 | 33.2% |
| B11 | V82_V49S_K119D_F213M | 0.004328811 | 0.001689296 | 0.006018107 | 71.93% | 1.43% | 0.010298792 | 28.1% |
| G2 | V15_A53E_F213M_R228Q | 0.010487326 | 0.016153895 | 0.026641221 | 39.37% | 2.60% | 0.010229509 | 60.6% |
| H1 | V8_K119A_Q161A_R228Q | 0.010308818 | 0.001266972 | 0.01157579 | 89.05% | 1.13% | 0.01005539 | 10.9% |
| F12 | V94_A17T_V49A_C230N | 0.010264191 | 0.001900458 | 0.01216465 | 84.38% | 1.19% | 0.01001186 | 15.6% |
| D7 | V52_K119A_S214G_L298A | 0.010130311 | 0.016365057 | 0.026495368 | 38.23% | 2.58% | 0.009881271 | 61.8% |
| C7 | V51_V49L_K119D_G205M | 0.004150303 | 0.001900458 | 0.006050762 | 68.59% | 1.44% | 0.009874099 | 31.4% |
| D10 | V76_V49A_F123A_Y288H | 0.010041057 | 0.001266972 | 0.011308029 | 88.80% | 1.10% | 0.009794211 | 11.2% |
| C2 | V11_K118N_K119A_V271E | 0.003971796 | 0.000844648 | 0.004816444 | 82.46% | 1.15% | 0.009449407 | 17.5% |
| H10 | V80_M162A_N173D_S214F | 0.009505534 | 0.102624744 | 0.112130278 | 8.48% | 10.94% | 0.009271853 | 91.5% |
| G10 | V79_V49A_Y121W_C230S | 0.009460907 | 0.00316743 | 0.012628337 | 74.92% | 1.23% | 0.009228323 | 25.1% |
| G7 | V55_V49S_Y216A_V294N | 0.009371653 | 0.00422324 | 0.013594893 | 68.94% | 1.33% | 0.009141246 | 31.1% |
| H11 | V88_A108G_Q161S_G205M | 0.009282399 | 0.017632029 | 0.026914428 | 34.49% | 2.63% | 0.009054204 | 65.5% |
| D1 | V4_K118Q_Q161W_S214F | 0.00361478 | 0.001478134 | 0.005092915 | 70.98% | 1.21% | 0.008600022 | 29.0% |
| C9 | V67_A108G_K119D_L298A | 0.002632988 | 0.001478134 | 0.004111122 | 64.05% | 0.98% | 0.006264214 | 36.0% |
| B9 | V66_C25V_F213M_Y216A | 0.002499107 | 0.001583715 | 0.004082823 | 61.21% | 0.97% | 0.005945694 | 38.8% |
| C12 | V91_N173D_F213M_V294F | 0.002454481 | 0.010558101 | 0.013012582 | 18.86% | 3.10% | 0.005839521 | 81.1% |
| G4 | V31_D227E_R228E_L298Q | 0.004462692 | 0.004645565 | 0.009108256 | 49.00% | 0.89% | 0.004352983 | 51.0% |
| G6 | V47_K118Q_F123A_R228E | 0.003570154 | 0.002639525 | 0.006209679 | 57.49% | 0.61% | 0.003482386 | 42.5% |

Figure 53:
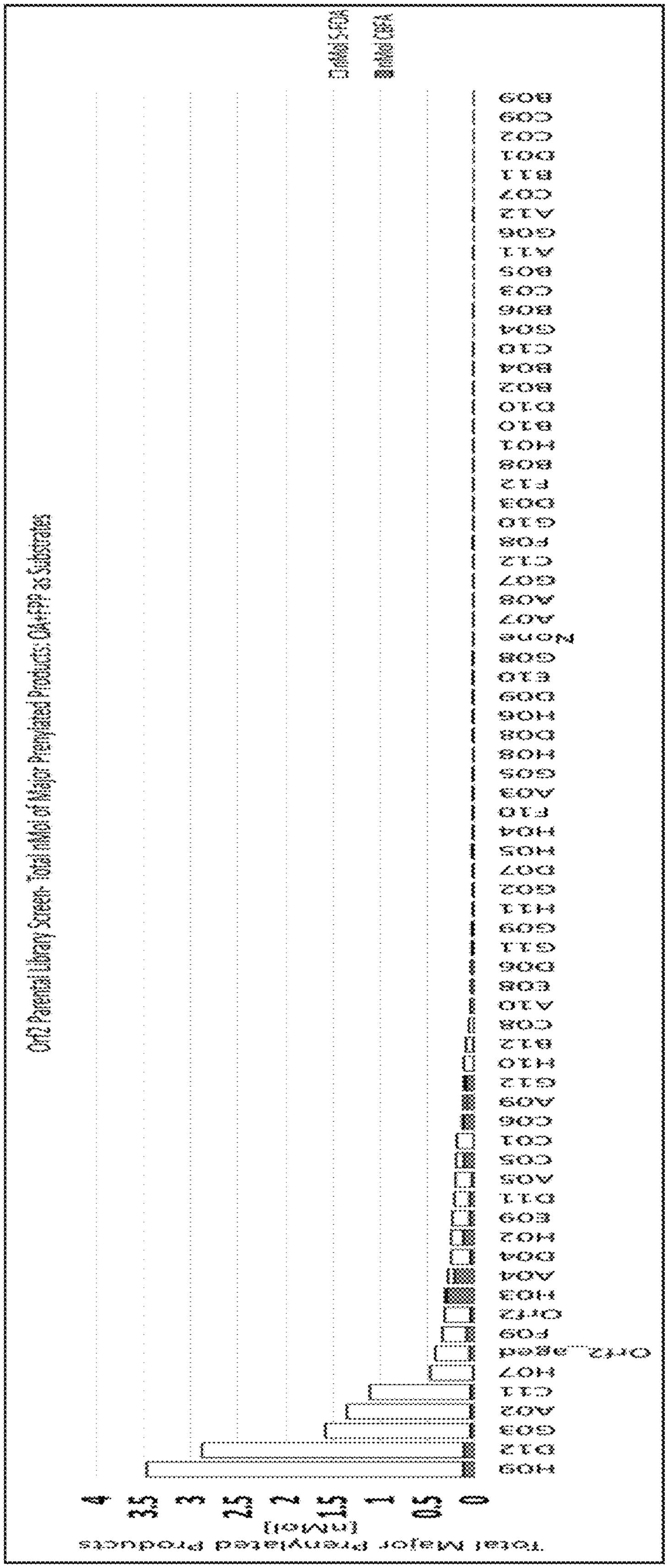
FIG. 53 shows the total nMol of prenylated products produced by ORF2 triple mutants using OA as substrate and FPP as donor.

The amount of CBFA or 5-FOA (in nMols) generated by each of the ORF2 triple mutant clones was measured using HPLC. FIG. 53 shows the total nMols of prenylated products generated using OA as substrate and FPP as donor by each of the ORF2 triple mutants, and the proportion of CBFA and 5-FOA within the total amount of prenylated products. An exemplary Wild Type ORF2 replicate is included in the graph for comparison purposes.

Figure 54:
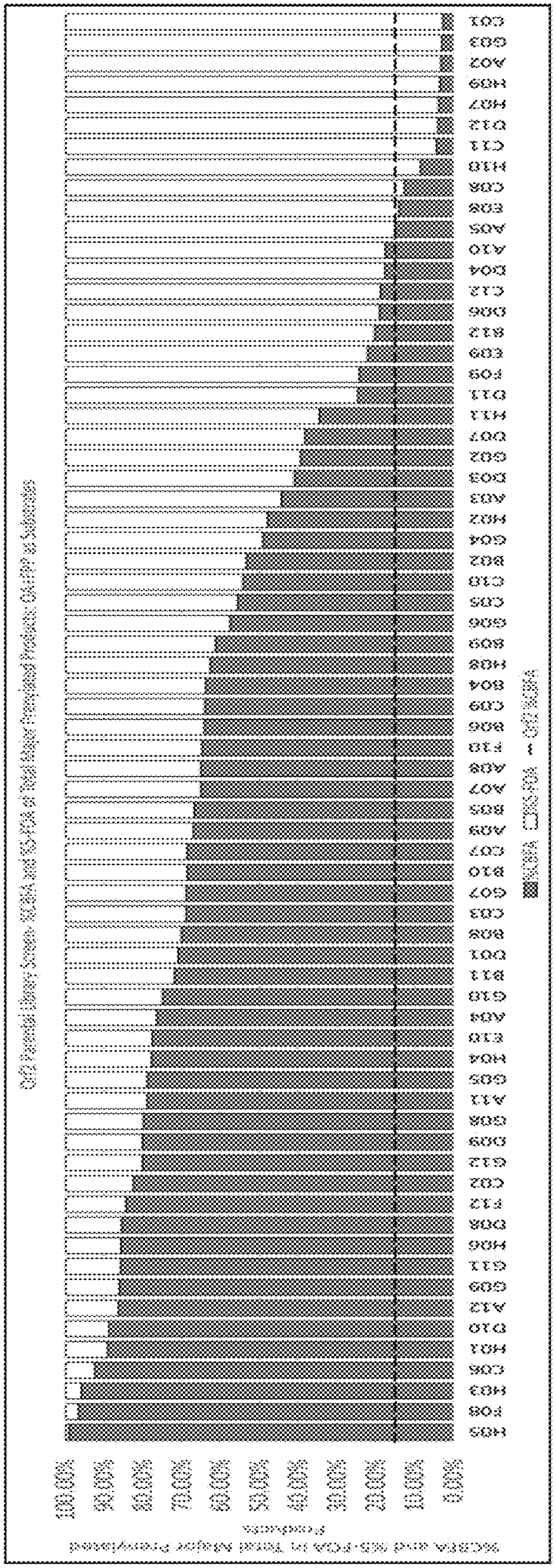
FIG. 54 shows that % CBFA produced by ORF2 triple mutants using OA as substrate and FPP as donor

FIG. 54 shows the % CBFA within the total prenylated products produced by each of the ORF2 triple mutant clones using OA as substrate and FPP as donor. In this graph, the mutant clones are ordered based on decreasing % CBFA (from left to right) they produce, with the %5-FOA depicted in red. The black threshold line on the graph indicates the % CBFA that is produced by the wild type enzyme.

Figure 55:
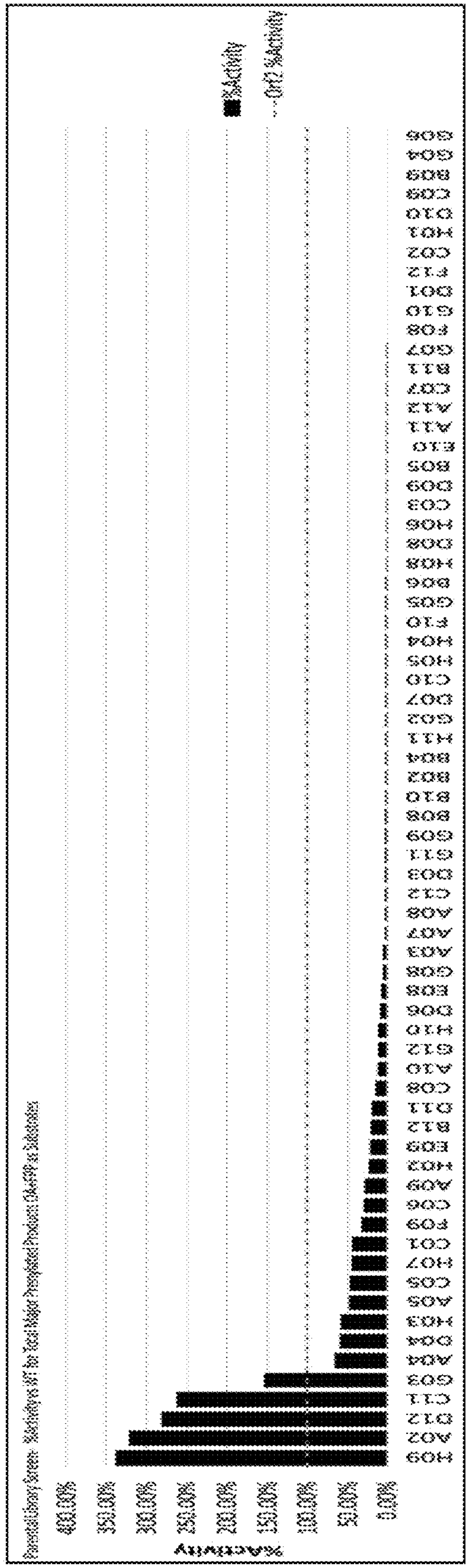
FIG. 55: % enzymatic activity of ORF2 triple mutants using OA as substrate and FPP as donor

FIG. 55 shows the ORF2 enzymatic activity (using OA as substrate and FPP as donor) of each of the triple mutant ORF2 clones relative to the wild type enzyme. % activity was calculated by dividing the nMols of total prenylated products produced by a mutant by the nMols of total prenylated products produced by the wild type control, and expressed as a percentage. The red threshold line is the wild type Orf2% activity.

Figure 56:
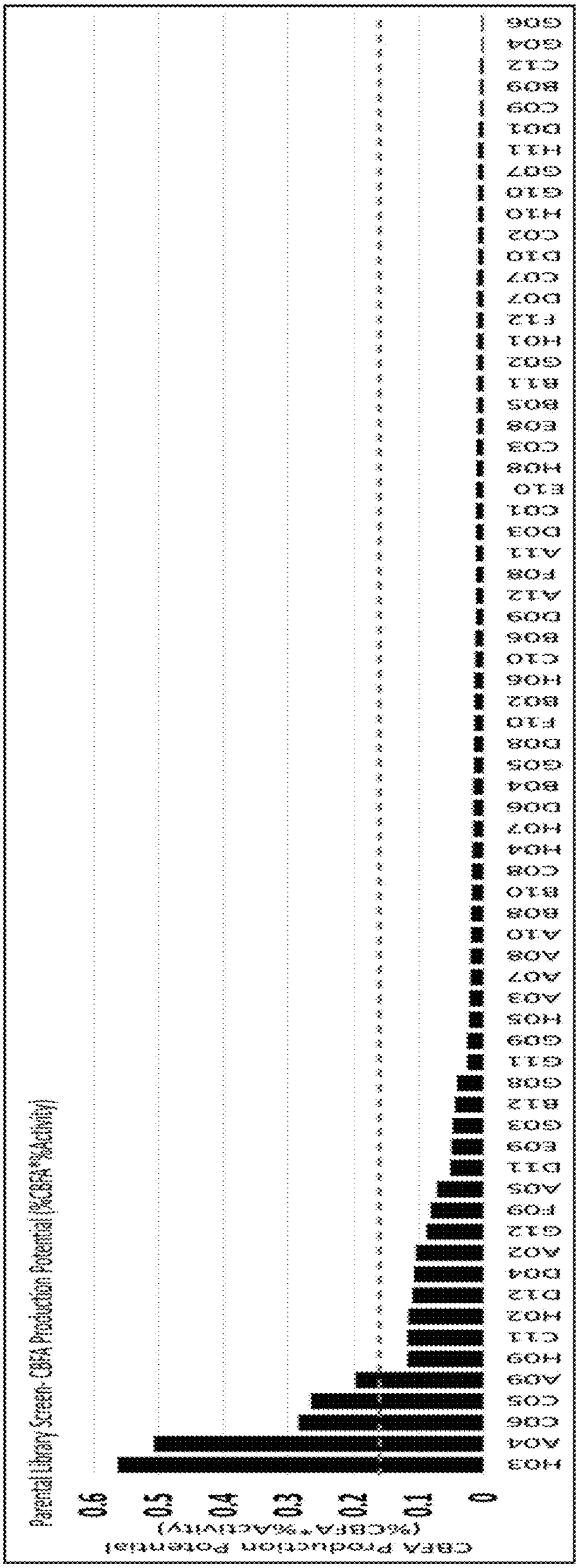
FIG. 56: CBFA production potential of ORF2 triple mutants using OA as substrate and FPP as donor

FIG. 56 shows the CBFA production potential of each of the ORF2 triple mutant clones when using OA as substrate and FPP as donor. CBFA production potential (interchangeably referred to herein as CBFA production quotient) represents the improvement in CBFA production vs. the wild type enzyme. CBFA production potential was calculated by multiplying the % CBFA by the % activity of each mutant. For instance, a wild type ORF2, which makes ~20% CBFA, and has an activity of 100%, would have a CBFA Production Potential of 0.2. The red threshold line on the graph represents this wild type value of 0.2.

While the CBFA production potential analysis shown in FIG. 56 is useful to rank ORF2 mutant clones based on the amount of CBFA produced, such an analysis would not differentiate between a mutant that made 100% CBFA but was 20% as active as wild-type ORF2; or a mutant that made 10% CBFA and was 200% as active as wild type ORF2. Therefore, we employed a cluster analysis by plotting the CBFA Production Potential vs. %5-FOA (FIG. 57). %5-FOA was calculated in a similar manner as % CBFA. We used the top 16 mutants ranked based on their CBFA production potential for this analysis. High 5-FOA producing mutants cluster together towards the right of the graph and high CBFA producing mutants cluster towards the left of the graph.

Based on the analysis performed in FIG. 57, 12 mutants which cluster to the left of the graph were selected (Table 53). These clones were targeted for "breakdown" analysis. Breakdown analysis involves breaking a parent triple mutant into all pair wise doubleton combinations of mutations as well as all singleton mutations that make up the parental clone. For each parental clone targeted six unique mutants are generated (3 doubles and 3 singles).

TABLE 53

Clones targeted for breakdown analysis based on CBFA production potential and %5-FOA produced, using OA as substrate and FPP as donor

| CBFA Production Rank | Clone ID | Mutations |
|---|---|---|
| 1 | H03 | V24_A17T_F213M_S214R |
| 2 | A04 | V25_L219F_V294N_Q295A |
| 3 | C06 | V43_Q161A_M162F_Q295A |
| 4 | C05 | V35_A53Q_S177Y_Y288H |
| 5 | A09 | V65_V49A_Q161S_V294A |
| 8 | H02 | V16_A53Q_S177W_L219F |
| 10 | D04 | V28_A53T_D166E_Q295W |
| 12 | G12 | V95_A17T_Q161W_A232S |
| 13 | F09 | V70_Q38G_D166E_Q295A |
| 14 | A05 | V33_A17T_C25V_E112G |
| 15 | D11 | V84_F123H_L174V_S177E |
| 16 | E09 | V69_A53T_M106E_Q161S |

Figure 58A:
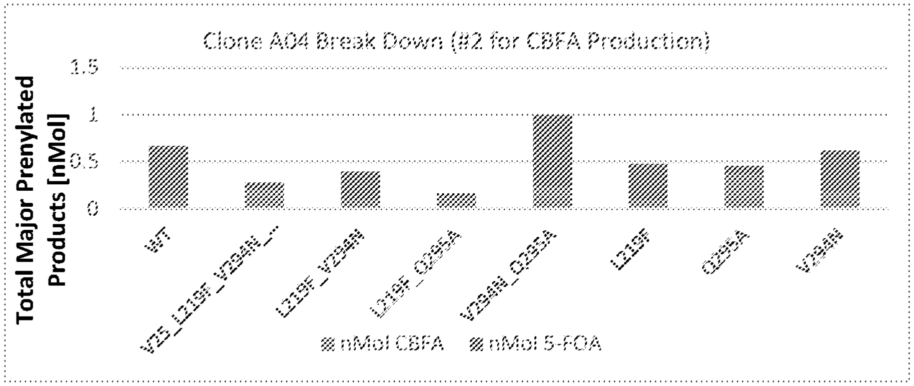
FIG. 58: Analysis of ORF-2 enzymatic function of mutants derived from the breakdown of ORF-2 triple mutant clone A04
Figure 58B:
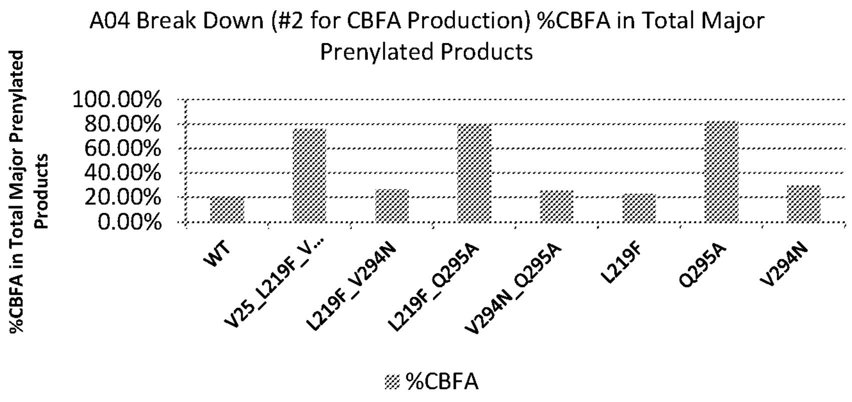
Figure 60A:
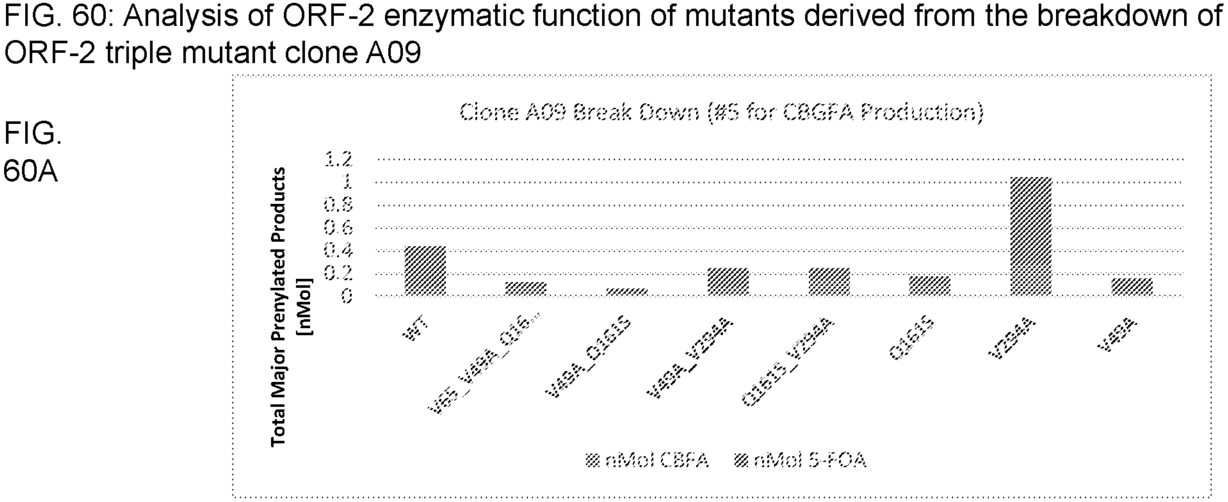
FIG. 60: Analysis of ORF-2 enzymatic function of mutants derived from the breakdown of ORF-2 triple mutant clone A09
Figure 60B:
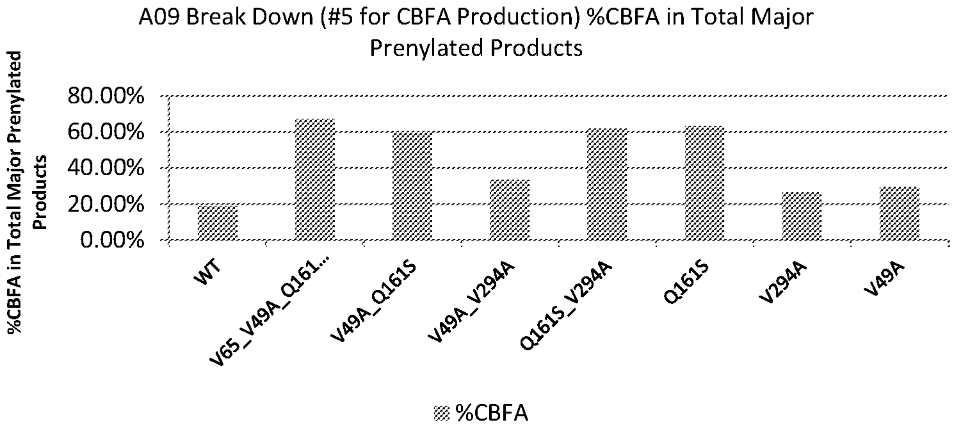
Figure 61A:
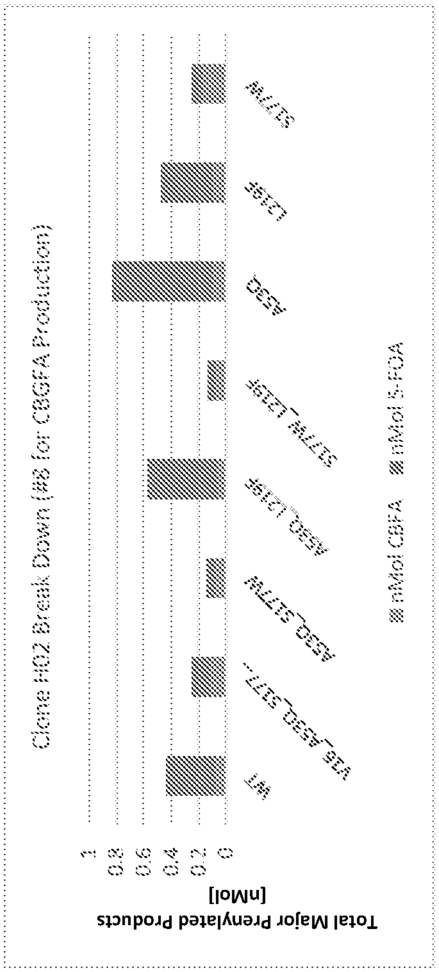
FIG. 61: Analysis of ORF-2 enzymatic function of mutants derived from the breakdown of ORF-2 triple mutant H02
Figure 61B:
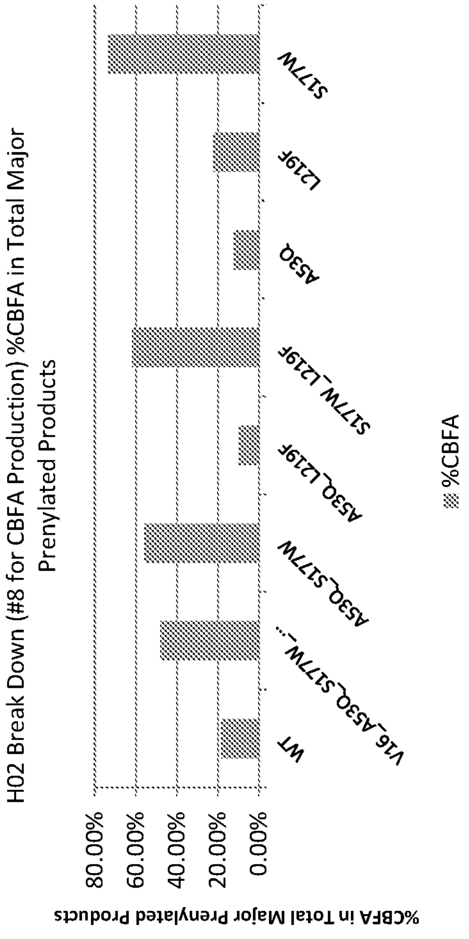
Figure 62A:
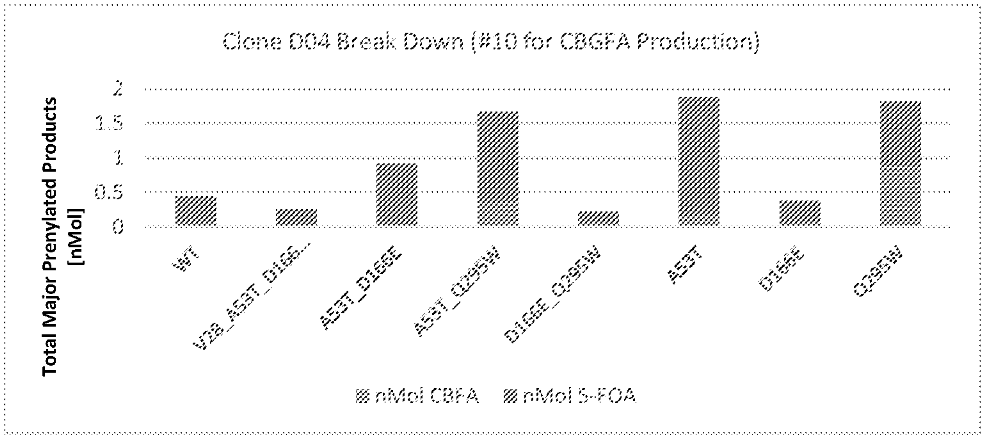
FIG. 62: Analysis of ORF-2 enzymatic function of mutants derived from the breakdown of ORF-2 triple mutant clone D04
Figure 62B:
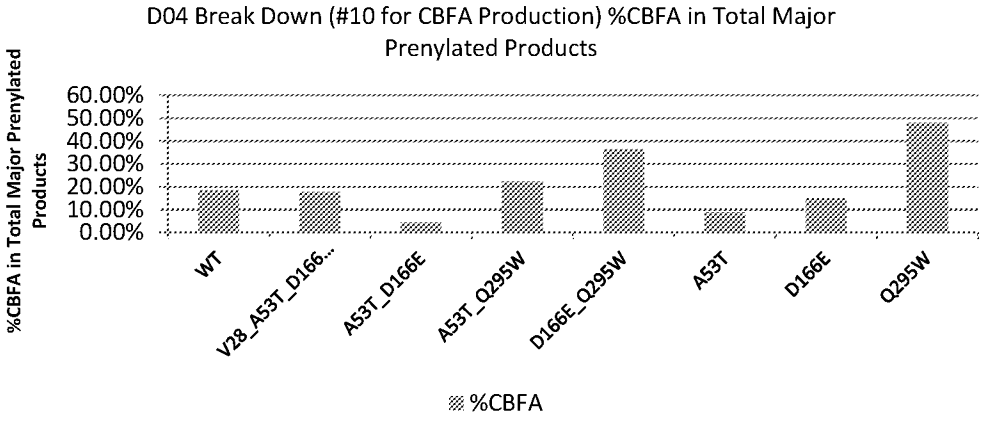
Figure 63A:
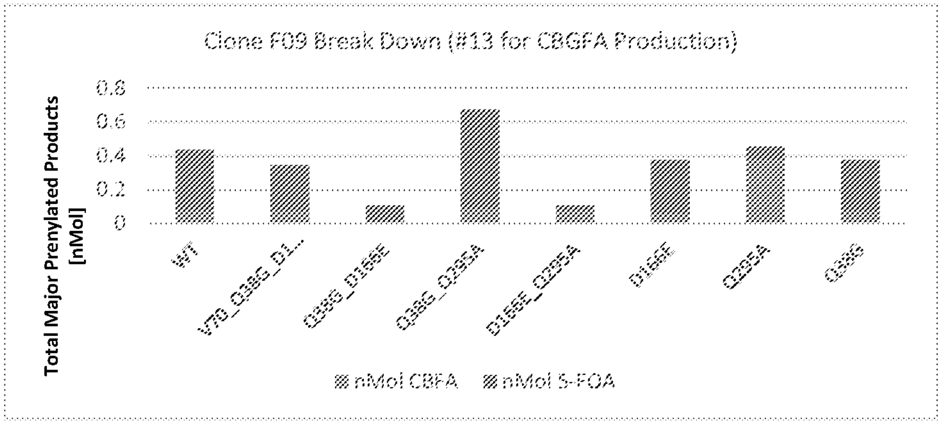
FIG. 63: Analysis of ORF-2 enzymatic function of mutants derived from the breakdown of ORF-2 triple mutant clone F09
Figure 63B:
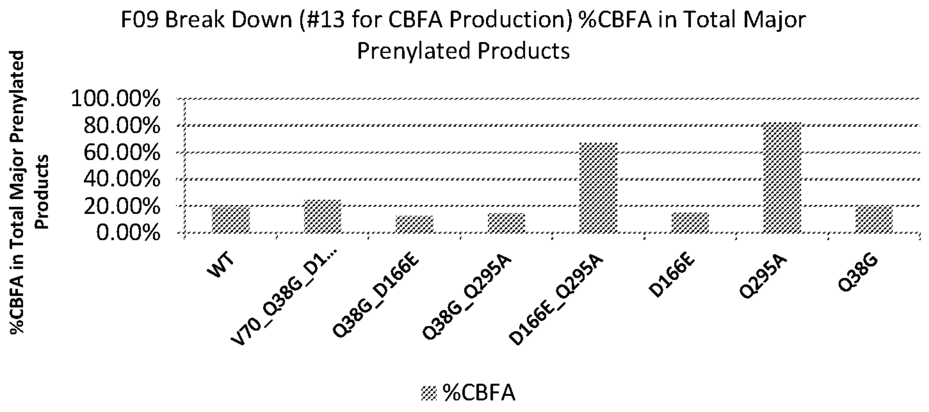
Figure 64A:
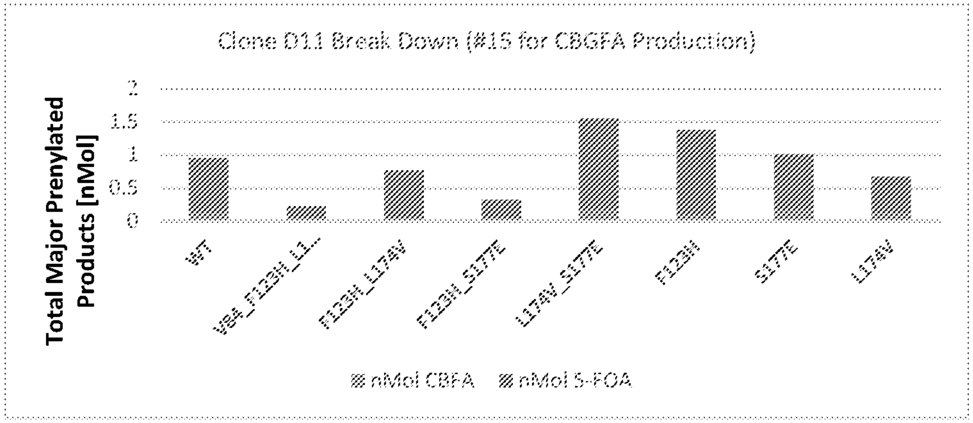
FIG. 64: Analysis of ORF-2 enzymatic function of mutants derived from the breakdown of ORF-2 triple mutant clone D11
Figure 64B:
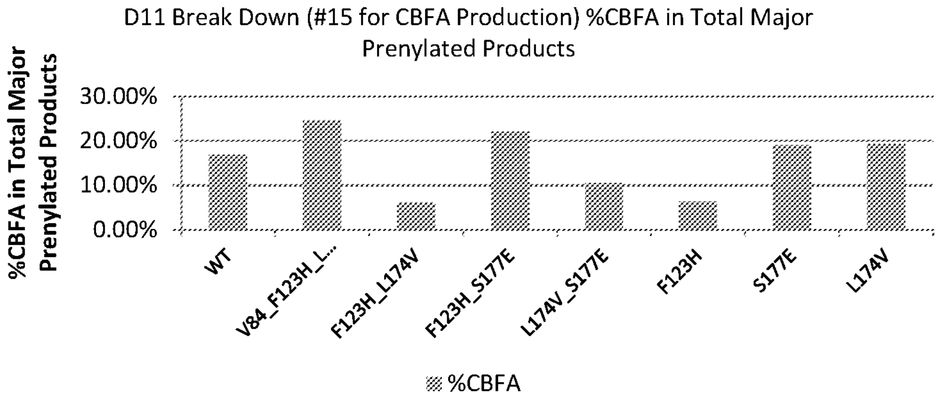
Figure 65A:
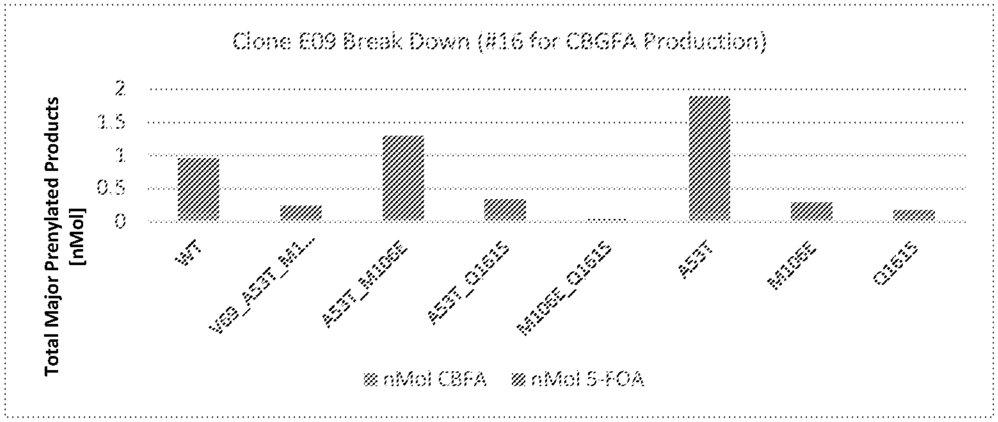
FIG. 65: Analysis of ORF-2 enzymatic function of mutan70ts derived from the breakdown of ORF-2 triple mutant clone E09
Figure 65B:
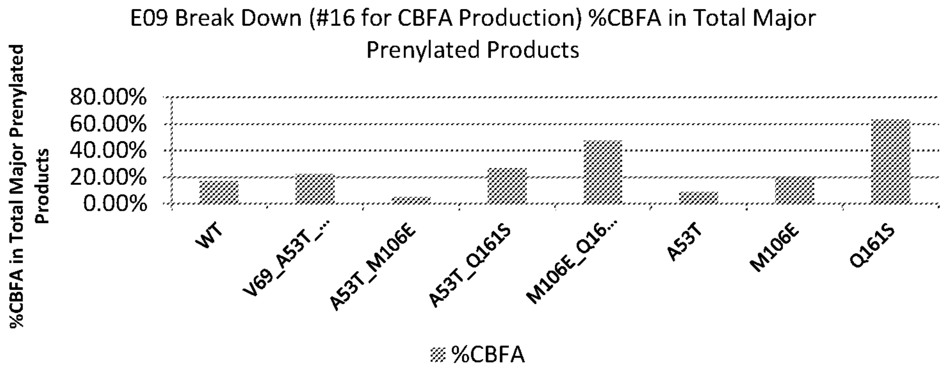

For the singleton and doubleton mutants resulting from the breakdown of triple mutants—H03, A04, C06, CO5, A09, H02, D04, G12, F09, A05, D11 and E09—the total amount of prenylated products (and the respective proportion of CBFA and 5-FOA); and % CBFA within the prenylated products was calculated. FIGS. 58-65 depict the total amount of prenylated products and % CBFA produced using OA as substrate and FPP as donor for the mutants derived from A04 (FIG. 58); CO5 (FIG. 59); A09 (FIG. 60); H02 (FIG. 61); D04 (FIG. 62); F09 (FIG. 63); D11 (FIG. 64); and E09 (FIG. 65). The % CBFA for these clones, along with the mutations they carry, are listed in Table 54.

In a similar manner, the triple mutants, H03, C06, A05 and G12, will also be subjected to "breakdown" analysis.

Further, the singleton and double mutants resulting from the breakdown of H03, C06, A05 and G12, will be analyzed to determine the total amount of prenylated products (and the respective proportion of CBFA and 5-FOA); and % CBFA within the prenylated products produced by these mutants, as described above.

TABLE 54

Breakdown CBFA Shift Summary Table using OA as substrate and FPP as donor

| RBP CLONE ID | Mutations | %CBFA |
|---|---|---|
| A04 | V25_L219F_V294N_Q295A | 76.34% |
| 004 | L219F_V294N | 26.34% |
| 005.1 | L219F_Q295A | 80.15% |
| 006 | V294N_Q295A | 25.26% |
| 039.2 | L219F | 22.55% |
| 042 | Q295A | 82.32% |
| 050 | V294N | 29.66% |
| C05 | V35_A53Q_S177Y_Y288H | 55.59% |
| 019 | A53Q_S177Y | 6.48% |
| 020 | A53Q_Y288H | 79.03% |
| 021 | S177Y_Y288H | 69.79% |
| 032 | A53Q | 12.50% |
| 047.2 | S177Y | 11.08% |
| 052 | Y288H | 89.32% |
| A09 | V65_V49A_Q161S_V294A | 67.08% |
| 022 | V49A_Q161S | 59.70% |
| 023 | V49A_V294A | 33.33% |
| 024 | Q161S_V294A | 61.84% |
| 041 | Q161S | 63.19% |
| 049 | V294A | 26.57% |
| 051 | V49A | 29.48% |
| H02 | V16_A53Q_S177W_L219F | 47.95% |
| 007.1 | A53Q_S177W | 55.80% |

TABLE 54-continued

Breakdown CBFA Shift Summary Table using OA as substrate and FPP as donor

| RBP CLONE ID | Mutations | %CBFA |
|---|---|---|
| 008 | A53Q_L219F | 10.06% |
| 009 | S177W_L219F | 61.76% |
| 032 | A53Q | 12.50% |
| 039.2 | L219F | 22.55% |
| 046 | S177W | 73.48% |
| D04 | V28_A53T_D166E_Q295W | 17.77% |
| 016 | A53T_D166E | 4.36% |
| 017 | A53T_Q295W | 22.07% |

TABLE 54-continued

| Breakdown CBFA Shift Summary Table using OA as substrate and FPP as donor | | |
|---|---|---|
| RBP CLONE ID | Mutations | %CBFA |
| 018 | D166E_Q295W | 36.56% |
| 033 | A53T | 8.62% |
| 034 | D166E | 14.98% |
| 043 | Q295W | 47.86% |
| F09 | V70_Q38G_D166E_Q295A | 24.25% |
| 001 | Q38G_D166E | 12.60% |
| 002 | Q38G_Q295A | 14.58% |
| 003 | D166E_Q295A | 66.80% |
| 034 | D166E | 14.98% |
| 042 | Q295A | 82.32% |
| 044 | Q38G | 20.42% |
| D11 | V84_F123H_L174V_S177E | 24.58% |
| 013 | F123H_L174V | 6.11% |
| 014 | F123H_S177E | 21.97% |
| 015 | L174V_S177E | 10.43% |
| 035 | F123H | 6.34% |
| 045 | S177E | 18.97% |

TABLE 54-continued

| Breakdown CBFA Shift Summary Table using OA as substrate and FPP as donor | | |
|---|---|---|
| RBP CLONE ID | Mutations | %CBFA |
| 038 | L174V | 19.23% |
| E09 | V69_A53T_M106E_Q161S | 22.04% |
| 025 | A53T_M106E | 5.13% |
| 026 | A53T_Q161S | 26.79% |
| 027 | M106E_Q161S | 47.19% |
| 033 | A53T | 8.62% |
| 040 | M106E | 19.05% |
| 041 | Q161S | 63.19% |

This analysis provided important insights into which positions on ORF2, when mutated, are likely to give rise to significant effects on the enzymatic activity of ORF2 in the reaction using Olivetolic Acid (OA) as substrate and FPP as donor. Based on this analysis, the amino acid sites listed in Table 55 were selected for targeted amino acid site saturation mutagenesis.

TABLE 55

| Site Saturation Target Table for CBFA shift using OA as substrate and FPP as donor | | | |
|---|---|---|---|
| Parental Clone | Mutations | Apparent CBFA Shift Controlling Residue | Target for Site Saturation |
| A4 | V25_L219F_V294N_Q295A | Q295A | Q295 |
| C5 | V35_A53Q_S177Y_Y288H | Y288H | Y288 |
| A9 | V65_V49A_Q161S_V294A | Q161S | Q161 |
| | | V49A | V49 |
| H2 | V16_A53Q_S177W_L219F | S177W | S177 |
| D4 | V28_A53T_D166E_Q295W | Q295W | Q295 |
| F9 | V70_Q38G_D166E_Q295A | Q295A | Q295 |
| E9 | V69_A53T_M106E_Q161S | Q161S | Q161 |
| G5 | V39_A53T_K118N_S214F | S214F | S214 |
| H11 | V88_A108G_Q161S_G205M | Q161S | Q161 |

Figure 66A:
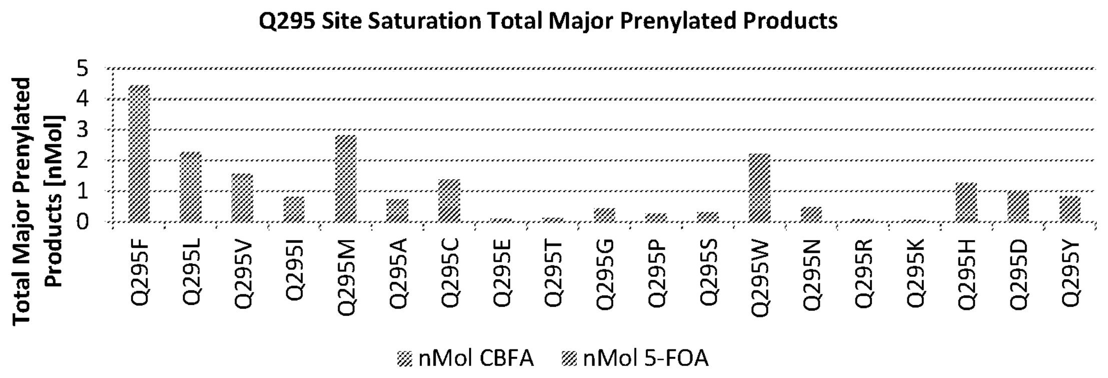
FIG. 66: Analysis of enzymatic activity of site-saturated ORF2 mutants of Q295 using OA as substrate and FPP as donor.
FIG. 66C: 5-FOA production (using OA as substrate and FPP as donor) by ORF2 mutants carrying site saturation Q295 mutations
Figure 66B:
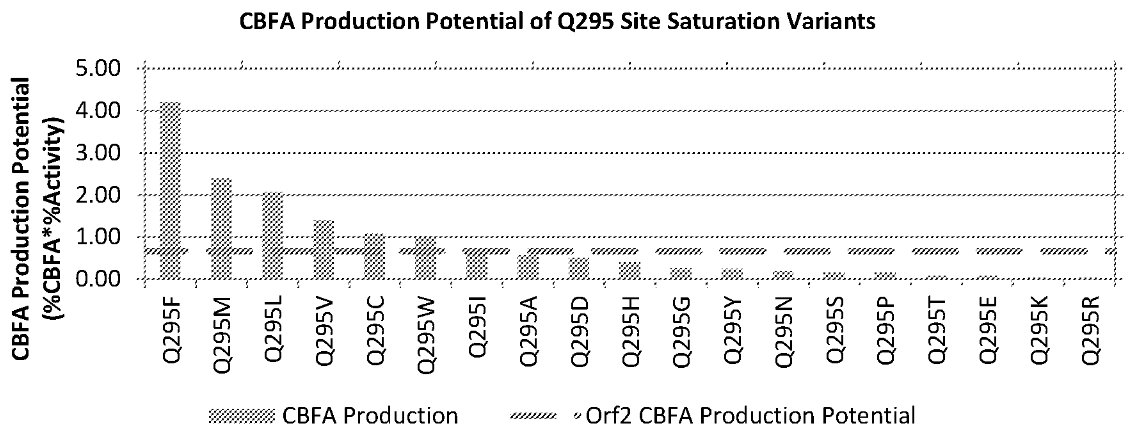
Figure 67A:
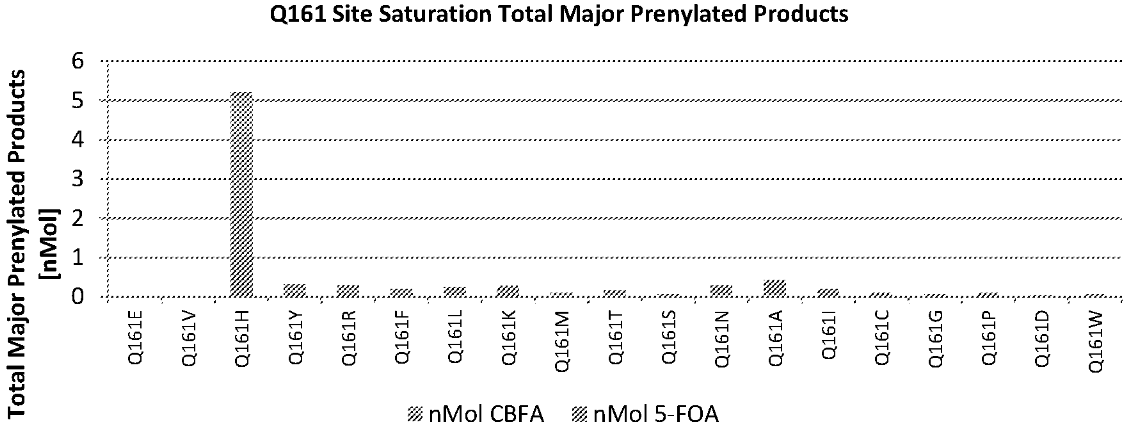
FIG. 67: Analysis of enzymatic activity of site-saturated ORF2 mutants of Q161 using OA as substrate and FPP as donor
FIG. 67C: 5-FOA production (using OA as substrate and FPP as donor) by ORF2 mutants carrying site saturation Q161 mutations
Figure 67B:
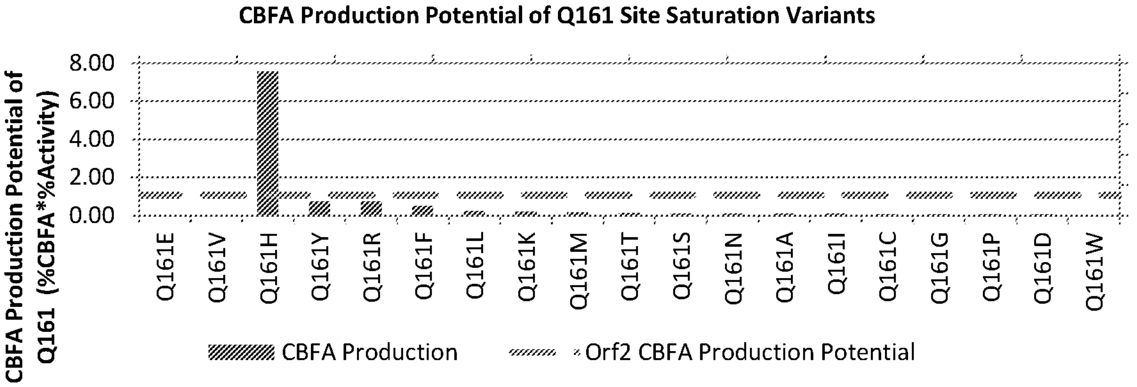
Figure 68A:
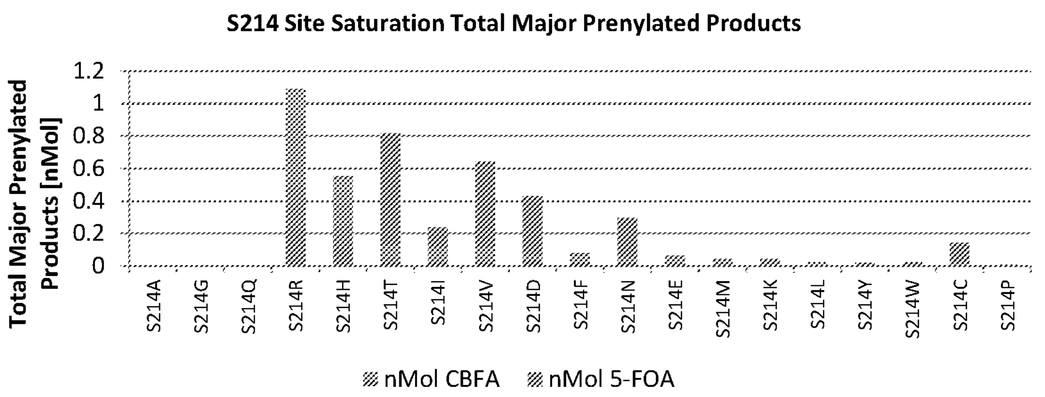
FIG. 68: Analysis of enzymatic activity of site-saturated ORF2 mutants of 5214 using OA as substrate and FPP as donor
FIG. 68C: 5-FOA production (using OA as substrate and FPP as donor) by ORF2 mutants carrying site saturation S214 mutations
Figure 68B:
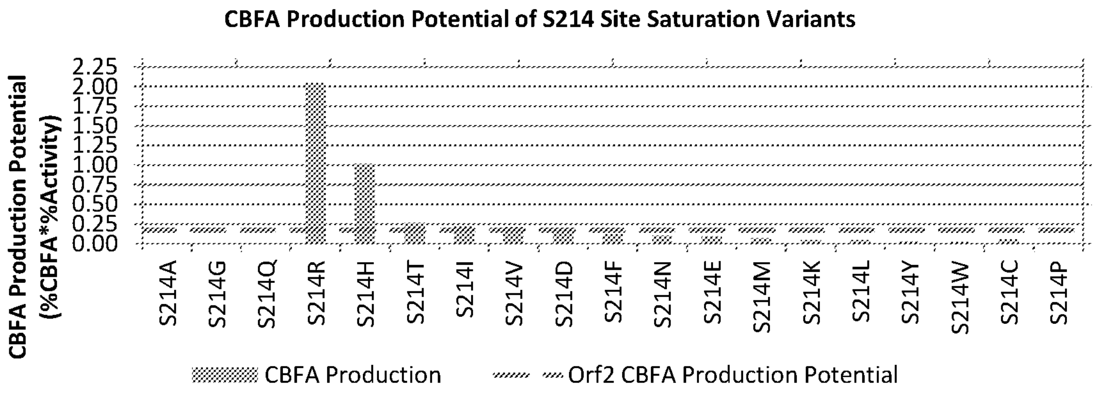
Figure 69:
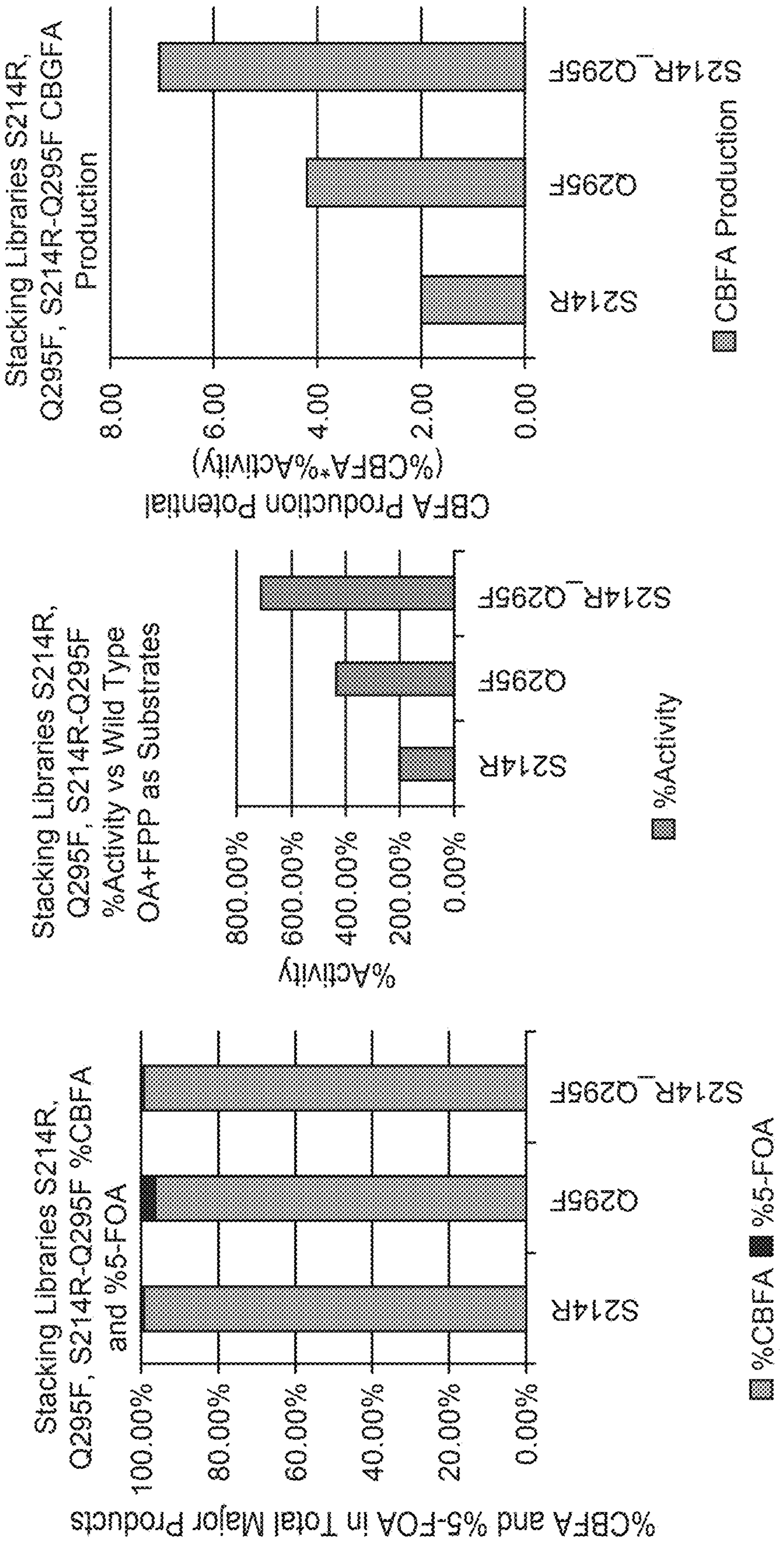
FIG. 69: ORF-2 activity (using OA as substrate and FPP as donor) of S214R-Q295F Stacking variant
Figure 70:
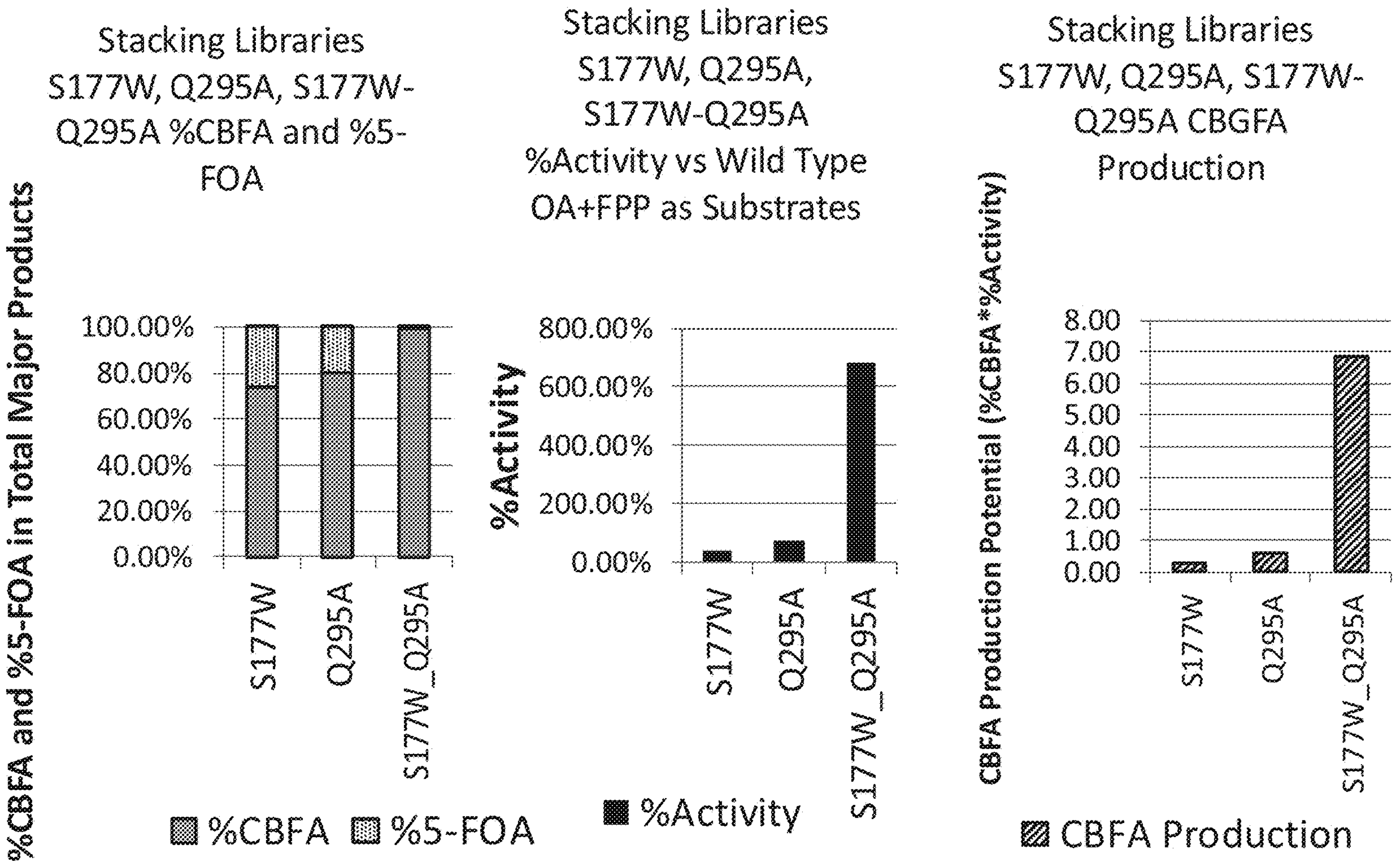
FIG. 70: ORF-2 activity (using OA as substrate and FPP as donor) of S177W-Q295A Stacking variant
Figure 71:
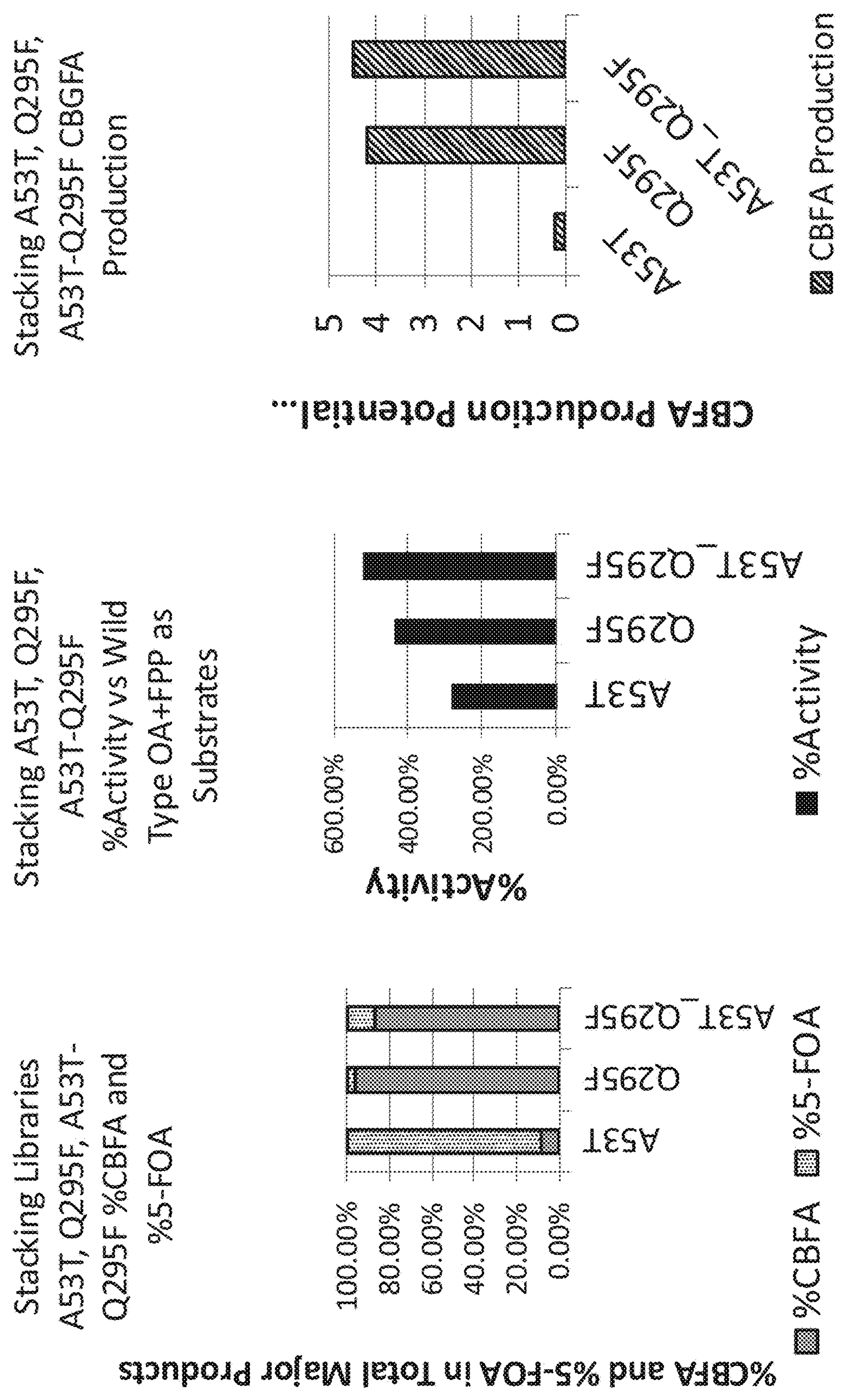
FIG. 71: ORF-2 activity (using OA as substrate and FPP as donor) of A53T-Q295F Stacking variant
Figure 72:
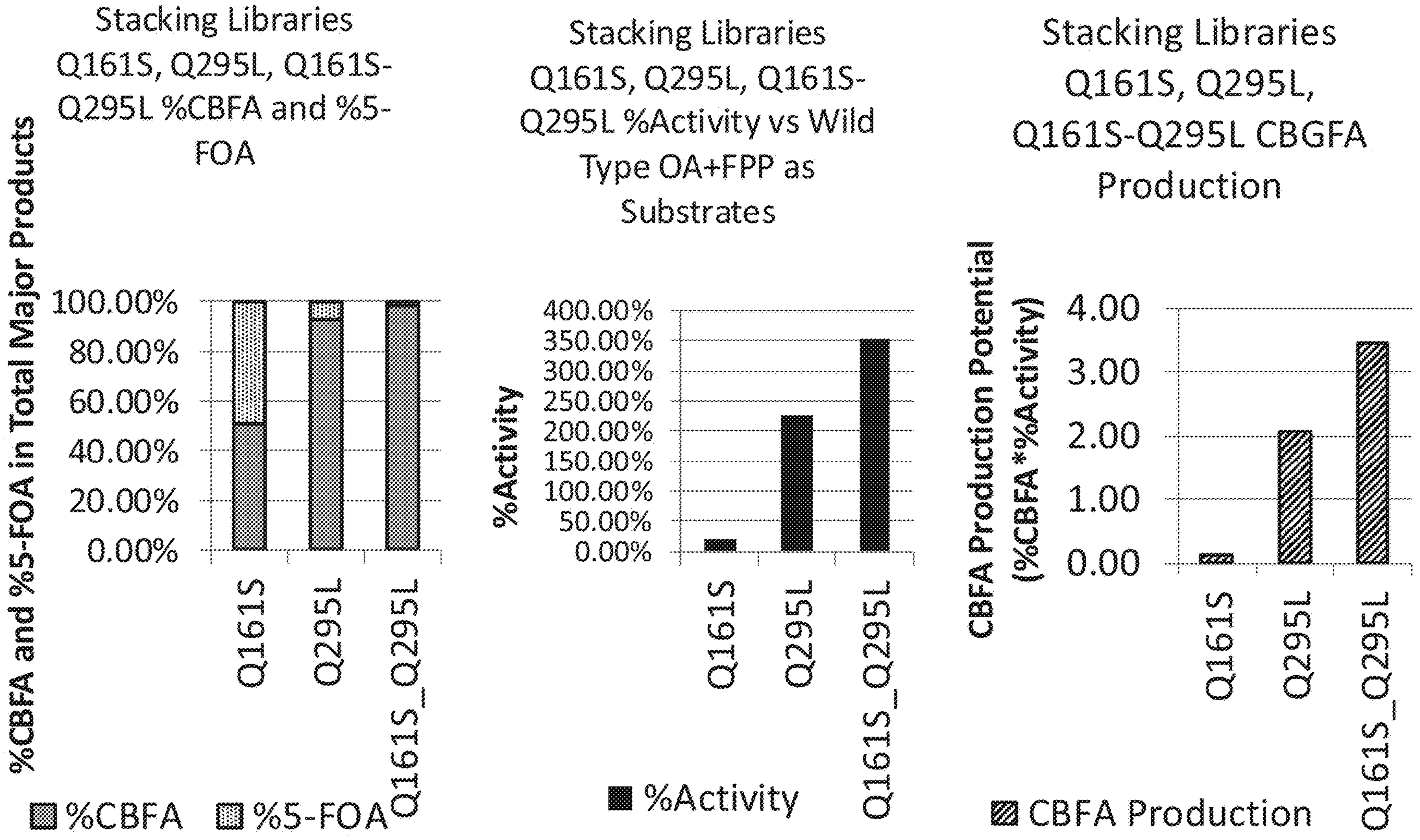
FIG. 72: ORF-2 activity (using OA as substrate and FPP as donor) of S177W-Q295A Stacking variant

Site saturated mutagenesis was done for Q295, Q161, and S214 by replacing the wild type residue with each of the other 19 standard amino acids. The amount of total prenylated products, the CBFA production potential and GOA production potential was measured for each of the site saturated mutants. These results are depicted in FIGS. 66, 67 and 68; and Tables 56, 57 and 58.

TABLE 56

| Q295 site saturated mutants OA + FPP | | | | | | | | |
|---|---|---|---|---|---|---|---|---|
| Mutations | nMol CBFA | nMol 5-FOA | Total Products | % CBFA | % Activity | CBFA Production | % 5-FOA | 5-FOA Production |
| Q295F | 4.27418779 | 0.16998543 | 4.44417322 | 96.18% | 437.21% | 4.20 | 3.82% | 0.17 |
| Q295L | 2.10848804 | 0.170724497 | 2.279212537 | 92.51% | 224.22% | 2.07 | 7.49% | 0.17 |
| Q295V | 1.427258122 | 0.13556602 | 1.562824142 | 91.33% | 153.75% | 1.40 | 8.67% | 0.13 |
| Q295I | 0.724473402 | 0.086893173 | 0.811366575 | 89.29% | 79.82% | 0.71 | 10.71% | 0.09 |
| Q295M | 2.435469475 | 0.376924214 | 2.812393689 | 86.60% | 276.68% | 2.40 | 13.40% | 0.37 |
| Q295A | 0.57894502 | 0.144223663 | 0.723168682 | 80.06% | 71.14% | 0.57 | 19.94% | 0.14 |
| Q295C | 1.090324884 | 0.27324366 | 1.363568544 | 79.96% | 134.14% | 1.07 | 20.04% | 0.27 |
| Q295E | 0.077740093 | 0.030724075 | 0.108464167 | 71.67% | 10.67% | 0.08 | 28.33% | 0.03 |
| Q295T | 0.082916815 | 0.038537069 | 0.121453885 | 68.27% | 11.95% | 0.08 | 31.73% | 0.04 |
| Q295G | 0.266601214 | 0.162594759 | 0.429195973 | 62.12% | 42.22% | 0.26 | 37.88% | 0.16 |
| Q295P | 0.157086755 | 0.101357772 | 0.258444527 | 60.78% | 25.43% | 0.15 | 39.22% | 0.10 |
| Q295S | 0.159942878 | 0.144012501 | 0.303955378 | 52.62% | 29.90% | 0.16 | 47.38% | 0.14 |
| Q295W | 1.019903606 | 1.181451528 | 2.201355134 | 46.33% | 216.56% | 1.00 | 53.67% | 1.16 |
| Q295N | 0.18814709 | 0.287919421 | 0.476066511 | 39.52% | 46.83% | 0.19 | 60.48% | 0.28 |
| Q295R | 0.025481971 | 0.049834238 | 0.075316209 | 33.83% | 7.41% | 0.03 | 66.17% | 0.05 |
| Q295K | 0.019189575 | 0.039804042 | 0.058993617 | 32.53% | 11.17% | 0.04 | 67.47% | 0.08 |
| Q295H | 0.403471974 | 0.870937771 | 1.274409745 | 31.66% | 125.37% | 0.40 | 68.34% | 0.86 |

TABLE 56-continued

| Q295 site saturated mutants OA + FPP | | | | | | | | |
|---|---|---|---|---|---|---|---|---|
| Mutations | nMol CBFA | nMol 5-FOA | Total Products | % CBFA | % Activity | CBFA Production | % 5-FOA | 5-FOA Production |
| Q295D | 0.264905391 | 0.69250586 | 0.957411251 | 27.67% | 181.27% | 0.50 | 72.33% | 1.31 |
| Q295Y | 0.130667619 | 0.700635598 | 0.831303216 | 15.72% | 157.39% | 0.25 | 84.28% | 1.33 |

TABLE 57

| Q161 site saturated mutants OA + FPP | | | | | | | | | | |
|---|---|---|---|---|---|---|---|---|---|---|
| Mutations | CBFA (8.362) | 5-FOA (8.805) | nMol CBFA | nMol 5-FOA | Total Products | % CBFA | % Activity | CBFA Production | % 5-FOA | 5-FOA Production Potential |
| Q161E | | | | | | | | | | |
| Q161V | | | | | | | | | | |
| Q161L | 0.16 | 0.1715 | 0.07140307 | 0.181071436 | 0.252474506 | 28.28% | 78.08% | 0.22 | 71.72% | 0.56 |
| Q161A | 0.1471 | 0.346 | 0.065646198 | 0.365310303 | 0.4309565 | 15.23% | 63.83% | 0.10 | 84.77% | 0.54 |
| Q161I | 0.0683 | 0.1596 | 0.030480186 | 0.168507296 | 0.198987481 | 15.32% | 61.54% | 0.09 | 84.68% | 0.52 |
| Q161N | 0.1186 | 0.232 | 0.052927526 | 0.244947949 | 0.297875474 | 17.77% | 56.40% | 0.10 | 82.23% | 0.46 |
| Q161T | 0.0924 | 0.1156 | 0.041235273 | 0.12205165 | 0.163286923 | 25.25% | 50.50% | 0.13 | 74.75% | 0.38 |
| Q161C | 0.0424 | 0.0787 | 0.018921814 | 0.083092257 | 0.10201407 | 18.55% | 31.55% | 0.06 | 81.45% | 0.26 |
| Q161Y | 0.5214 | 0.0721 | 0.232684755 | 0.07612391 | 0.308808665 | 75.35% | 95.50% | 0.72 | 24.65% | 0.24 |
| Q161K | 0.3091 | 0.1306 | 0.137941806 | 0.137888802 | 0.275830609 | 50.01% | 40.85% | 0.20 | 49.99% | 0.20 |
| Q161R | 0.5209 | 0.0589 | 0.232461621 | 0.062187216 | 0.294648837 | 78.89% | 91.12% | 0.72 | 21.11% | 0.19 |
| Q161H | 11.4099 | 0.1017 | 5.091886826 | 0.10737589 | 5.199262716 | 97.93% | 770.04% | 7.54 | 2.07% | 0.16 |
| Q161M | 0.1041 | 0.0444 | 0.046456623 | 0.046877969 | 0.093334592 | 49.77% | 28.86% | 0.14 | 50.23% | 0.14 |
| Q161F | 0.3662 | 0.0404 | 0.163423777 | 0.042654729 | 0.206078506 | 79.30% | 63.73% | 0.51 | 20.70% | 0.13 |
| Q161S | 0.0787 | 0.0319 | 0.035121385 | 0.033680343 | 0.068801728 | 51.05% | 21.28% | 0.11 | 48.95% | 0.10 |
| Q161P | 0.0752 | 0.0658 | 0.033559443 | 0.069472306 | 0.103031749 | 32.57% | 15.43% | 0.05 | 67.43% | 0.10 |
| Q161G | 0.0685 | 0.0403 | 0.030569439 | 0.042549148 | 0.073118587 | 41.81% | 13.84% | 0.06 | 58.19% | 0.08 |
| Q161W | 0.0553 | 0.0372 | 0.024678686 | 0.039276137 | 0.063954823 | 38.59% | 9.58% | 0.04 | 61.41% | 0.06 |
| Q161D | 0.0711 | 0.0036 | 0.031729739 | 0.003800916 | 0.035530656 | 89.30% | 5.32% | 0.05 | 10.70% | 0.01 |

TABLE 58

| S214 site saturated mutants OA + FPP | | | | | | | | |
|---|---|---|---|---|---|---|---|---|
| Mutations | nMol CBFA | nMol 5-FOA | Total Products | % CBFA | % Activity | CBFA Production | % 5-FOA | 5-FOA Production |
| S214A | | | | | | | | |
| S214G | | | | | | | | |
| S214Q | | | | | | | | |
| S214T | 0.13803106 | 0.678041261 | 0.816072321 | 16.91% | 154.51% | 0.26 | 83.09% | 1.28375 |
| S214V | 0.110942521 | 0.534451084 | 0.645393605 | 17.19% | 122.19% | 0.21 | 82.81% | 1.01189 |
| S214D | 0.076535166 | 0.353379648 | 0.429914814 | 17.80% | 81.40% | 0.14 | 82.20% | 0.66906 |
| S214N | 0.053507676 | 0.241569356 | 0.295077032 | 18.13% | 55.87% | 0.10 | 81.87% | 0.45737 |
| S214C | 0.016199572 | 0.126697215 | 0.142896786 | 11.34% | 0.439674 | 0.05 | 88.66% | 0.38983 |
| S214I | 0.113620136 | 0.123635365 | 0.237255501 | 47.89% | 44.92% | 0.22 | 52.11% | 0.23408 |
| S214W | 0.009014638 | 0.016153895 | 0.025168533 | 35.82% | 4.77% | 0.02 | 64.18% | 0.03058 |
| S214H | 0.536058551 | 0.014886923 | 0.550945473 | 97.30% | 104.31% | 1.01 | 2.70% | 0.02819 |
| S214E | 0.047616923 | 0.014464599 | 0.062081521 | 76.70% | 11.75% | 0.09 | 23.30% | 0.02739 |
| S214K | 0.027713317 | 0.017315286 | 0.045028603 | 61.55% | 6.67% | 0.04 | 38.45% | 0.02565 |
| S214F | 0.063816494 | 0.01351437 | 0.077330864 | 82.52% | 14.64% | 0.12 | 17.48% | 0.02559 |
| S214M | 0.034139593 | 0.009713453 | 0.043853046 | 77.85% | 8.30% | 0.06 | 22.15% | 0.01839 |
| S214R | 1.079926812 | 0.008974386 | 1.088901198 | 99.18% | 206.16% | 2.04 | 0.82% | 0.01699 |
| S214P | 0.00303463 | 0.005384632 | 0.008419262 | 36.04% | 0.025905 | 0.01 | 63.96% | 0.01657 |
| S214Y | 0.013254195 | 0.006123699 | 0.019377894 | 68.40% | 3.67% | 0.03 | 31.60% | 0.01159 |
| S214L | 0.02128704 | 0.004117659 | 0.0254047 | 83.79% | 4.81% | 0.04 | 16.21% | 0.0078 |

Similarly, site saturated mutagenesis will also be completed for the other amino acid residues targeted for site saturation listed in Table 55; and the amount of total prenylated products and the CBFA production potential will be measured for each of these site saturated mutants.

From the results described above, multiple mutations of Q295, Q161 and 5214 that have significantly higher CBFA production potential and/or the total amount of prenylated products, as compared to WT ORF2, were identified. Thus, the ORF2 mutants disclosed herein have unexpectedly superior enzymatic functions, in a reaction using OA as a substrate and FPP as donor, as compared to WT ORF2.

Finally, ORF2 stacking mutants, that carry different novel combinations of the mutations identified by our analysis as being important for ORF2's enzymatic activity, were analyzed to determine the total amount of prenylated products they produce; % enzymatic activity, % CBFA, and CBFA production potential. The analysis of the stacking mutants shows that multiple stacking mutants have significantly higher % enzymatic activity, % CBFA, and CBFA production potential, compared to the WT ORF2 or either singleton substitution variant on its own, thereby indicating that the ORF2 stacking mutants disclosed herein have synergistically enhanced effects compared to the individual single mutants. Thus, the ORF2 stacking mutants disclosed herein have unexpectedly superior enzymatic functions, in a reaction using OA and FPP, as compared to WT ORF2.

For instance, ORF2 double mutants—S214R-Q295F; S177W-Q295A; A53T-Q295F; and Q161S-Q295L have synergistically enhanced CBFA production potential and % activity as compared to either of the single mutants. See FIGS. 69-72; and Table 59.

More stacking mutants will be generated as described above, based on the breakdown analysis of additional triple mutants and planned site saturation mutagenesis experiments described above. These stacking mutants will further be analyzed to determine their % enzymatic activity, % CBFA, %5-FOA and CBFA production potential.

TABLE 59

Stacking Representative Results (using OA as substrate and FPP as donor) by ORF2 stacking mutants

| RBP CLONE ID | Mutations | CBFA (8.362) | 5-FOA (8.805) | nMol CBFA | nMol 5-FOA | Total Products | % CBFA | % Activity | CBFA Production | % 5-FOA |
|---|---|---|---|---|---|---|---|---|---|---|
| BB05 | S214R | 2.4199 | 0.0085 | 1.079926812 | 0.008974386 | 1.088901198 | 99.18% | 206.16% | 2.04 | 0.82% |
| 056.2 | Q295F | 9.5776 | 0.161 | 4.27418779 | 0.16998543 | 4.44417322 | 96.18% | 437.21% | 4.20 | 3.82% |
| ST13 | S214R_Q295F | 10.6601 | 0.0249 | 4.757274188 | 0.026289672 | 4.78356386 | 99.45% | 708.48% | 7.05 | 0.55% |
| 046 | S177W | 0.413 | 0.063 | 0.184309175 | 0.066516038 | 0.250825213 | 73.48% | 37.57% | 0.28 | 26.52% |
| 042.3 | Q295A | 1.2973 | 0.1366 | 0.57894502 | 0.144223663 | 0.723168682 | 80.06% | 71.14% | 0.57 | 19.94% |
| ST01 | S177W_Q295A | 10.3347 | 0.0119 | 4.612058194 | 0.01256414 | 4.624622334 | 99.73% | 684.94% | 6.83 | 0.27% |
| 033 | A53T | 0.3639 | 1.6305 | 0.162397358 | 1.721498406 | 1.883895764 | 8.62% | 282.15% | 0.24322 | 91.38% |
| 056.2 | Q295F | 9.5776 | 0.161 | 4.27418779 | 0.16998543 | 4.44417322 | 96.18% | 437.21% | 4.20 | 3.82% |
| ST08 | A53T_Q295F | 6.8272 | 0.4389 | 3.046769011 | 0.463395063 | 3.510164074 | 86.80% | 519.88% | 4.51 | 13.20% |
| EE06 | Q161S | 0.0787 | 0.0319 | 0.035121385 | 0.033680343 | 0.068801728 | 51.05% | 21.28% | 0.11 | 48.95% |
| 061.2 | Q295L | 4.7247 | 0.1617 | 2.10848804 | 0.170724497 | 2.279212537 | 92.51% | 224.22% | 2.07 | 7.49% |
| ST11L | Q161S_Q295L | 5.2287 | 0.0436 | 2.333407712 | 0.046033321 | 2.379441033 | 98.07% | 352.41% | 3.46 | 1.93% |

Example 35—Generation of ORF2 Variants which Synthesize an Altered Amount of 5-DOA and/or 3-DOA, Compared to WT ORF2

Table 60 provides a summary of the analysis performed on the enzymatic activity of the ORF2 variants to produce CBGA and 5-DOA using Olivetolic Acid (OA) as substrate and DMAPP as donor. Table 60 lists the mutations within each of the tripleton mutants as well the nMol of 3-DOA produced, nMol of 5-DOA produced, total prenylated products produced (nMol of 3-DOA+5-DOA), %3-DOA within total prenylated products (nMol of 3-DOA/[nMol of 3-DOA+5-DOA]), % enzymatic activity (total prenylated products produced by a mutant/total prenylated products produced by wild-type ORF2), 3-DOA production (%3-DOA among total prenylated products*% enzymatic activity), and %5-DOA within prenylated products (nMol of 5-DOA/[nMol of 3-DOA+5-DOA]) for each of the ORF2 variants.

TABLE 60

Analysis of ORF2 mutants and WT ORF2 based on production of 3-DOA from OA and DMAPP

| CLONE | Mutations | nMol 3-DOA | nMol 5-DOA | nMol Total Products | % 3-DOA | % 5-DOA | % Activity | 3-DOA Production | 5-DOA Production |
|---|---|---|---|---|---|---|---|---|---|
| WT | WT | 0.070427374 | 0.032532794 | 0.102960168 | 68.40% | 31.60% | 100.00% | 0.68 | 0.32 |
| C6 | V43_Q161A_M162F_Q295A | 0.655232239 | 0.005112296 | 0.660344535 | 99.23% | 0.77% | 640.01% | 6.35 | 0.05 |
| A9 | V65_V49A_Q161S_V294A | 0.290469974 | 0.058210464 | 0.348680438 | 83.31% | 16.69% | 337.94% | 2.82 | 0.56 |
| A4 | V25_L219F_V294N_Q295A | 0.260581283 | 0.02649099 | 0.287072273 | 90.77% | 9.23% | 278.23% | 2.53 | 0.26 |
| G12 | V95_A17T_Q161W_A232S | 0.16662086 | 0.038923165 | 0.205544025 | 81.06% | 18.94% | 164.32% | 1.33 | 0.31 |

TABLE 60-continued

Analysis of ORF2 mutants and WT ORF2 based on production of 3-DOA from OA and DMAPP

| CLONE | Mutations | nMol 3-DOA | nMol 5-DOA | nMol Total Products | % 3-DOA | % 5-DOA | % Activity | 3-DOA Production | 5-DOA Production |
|---|---|---|---|---|---|---|---|---|---|
| H03 | V24_A17T_F213M_S214R | 0.095334616 | 0.002904714 | 0.09823933 | 97.04% | 2.96% | 122.88% | 1.19 | 0.04 |
| D6 | V44_A53E_Q161A_V294N | 0.11757936 | 0.036250828 | 0.153830187 | 76.43% | 23.57% | 149.09% | 1.14 | 0.35 |
| F9 | V70_Q38G_D166E_Q295A | 0.120241858 | 0.04647542 | 0.166717278 | 72.12% | 27.88% | 133.28% | 0.96 | 0.37 |
| D12 | V92_A53T_E112D_G205M | 0.10478219 | 0.081912928 | 0.186695119 | 56.12% | 43.88% | 149.25% | 0.84 | 0.65 |
| C5 | V35_A53Q_S177Y_Y288H | 0.085285832 | 0.055073373 | 0.140359205 | 60.76% | 39.24% | 136.04% | 0.83 | 0.53 |
| D4 | V28_A53T_D166E_Q295W | 0.081592689 | 0.054550525 | 0.136143214 | 59.93% | 40.07% | 131.95% | 0.79 | 0.53 |
| A2 | V9_Q38G_E112D_F123H | 0.077384224 | 0.098063137 | 0.175447361 | 44.11% | 55.89% | 170.04% | 0.75 | 0.95 |
| E9 | V69_A53T_M1O6E_Q161S | 0.091040264 | 0.032532794 | 0.123573058 | 73.67% | 26.33% | 98.79% | 0.73 | 0.26 |
| D11 | V84_F123H_L174V_S177E | 0.089322523 | 0.033113737 | 0.12243626 | 72.95% | 27.05% | 97.88% | 0.71 | 0.26 |
| H2 | V16_A53Q_S177W_L219F | 0.079874948 | 0.04008505 | 0.119959998 | 66.58% | 33.42% | 95.90% | 0.64 | 0.32 |
| C11 | V83_E112D_L219F_V294F | 0.065445926 | 0.038167939 | 0.103613864 | 63.16% | 36.84% | 100.42% | 0.63 | 0.37 |
| H9 | V72_E112G_G205M_L298W | 0.052391095 | 0.094693669 | 0.147084764 | 35.62% | 64.38% | 117.58% | 0.42 | 0.76 |
| A5 | V33_A17T_C25V_E112G | 0.040452796 | 0.029105232 | 0.069558028 | 58.16% | 41.84% | 67.42% | 0.39 | 0.28 |
| A3 | V17_V49L_F123A_Y283L | 0.03134877 | 0.009469367 | 0.040818137 | 76.80% | 23.20% | 39.56% | 0.30 | 0.09 |
| B12 | V90_A17T_F123W_L298A | 0.031005222 | 0.010979818 | 0.04198504 | 73.85% | 26.15% | 40.69% | 0.30 | 0.11 |
| C1 | V3_V49S_M162A_Y283L | 0.030404013 | 0.043861178 | 0.074265191 | 40.94% | 59.06% | 71.98% | 0.29 | 0.43 |
| H11 | V88_A108G_Q161S_G205M | 0.034354817 | 0.05054202 | 0.084896836 | 40.47% | 59.53% | 67.87% | 0.27 | 0.40 |
| C8 | V59_V49S_S214G_V294A | 0.027741514 | 0.020391091 | 0.048132605 | 57.64% | 42.36% | 46.65% | 0.27 | 0.20 |
| H7 | V56_F123A_M162F_S214G | 0.032637076 | 0.026723367 | 0.059360442 | 54.98% | 45.02% | 47.45% | 0.26 | 0.21 |
| A12 | V89_Y121W_S177Y_G286E | 0.026453209 | 0.012083609 | 0.038536818 | 68.64% | 31.36% | 37.35% | 0.26 | 0.12 |
| H4 | V32_M162A_C209G_Y288H | 0.030060464 | 0.004066599 | 0.034127064 | 88.08% | 11.92% | 27.28% | 0.24 | 0.03 |
| A11 | V81_V49L_D166E_L274V | 0.024649581 | 0.012838835 | 0.037488416 | 65.75% | 34.25% | 36.33% | 0.24 | 0.12 |
| D3 | V20_D227E_C230N_Q295W | 0.024134259 | 0.013768343 | 0.037902602 | 63.67% | 36.33% | 36.74% | 0.23 | 0.13 |
| A10 | V73_V49S_K118Q_S177E | 0.024048372 | 0.012374081 | 0.036422452 | 66.03% | 33.97% | 35.30% | 0.23 | 0.12 |
| C10 | V75_A53Q_L274V_Q295A | 0.023017727 | 0.005518956 | 0.028536683 | 80.66% | 19.34% | 27.66% | 0.22 | 0.05 |
| C7 | V51_V49L_K119D_G205M | 0.022588292 | 0.006041805 | 0.028630097 | 78.90% | 21.10% | 27.75% | 0.22 | 0.06 |
| H5 | V40_S177E_S214R_R228E | 0.026624983 | 0.004066599 | 0.030691582 | 86.75% | 13.25% | 24.54% | 0.21 | 0.03 |
| A7 | V49_G205L_R228E_C230N | 0.021042325 | 0.010747441 | 0.031789766 | 66.19% | 33.81% | 30.81% | 0.20 | 0.10 |
| G3 | V23_L219F_Y283L_L298W | 0.024907242 | 0.024980538 | 0.04988778 | 49.93% | 50.07% | 39.88% | 0.20 | 0.20 |
| H1 | V8_K119A_Q161A_2R28Q | 0.024907242 | 0.002904714 | 0.027811956 | 89.56% | 10.44% | 22.23% | 0.20 | 0.02 |
| C9 | V67_A108G_K119D_L298A | 0.020527003 | 0.004821825 | 0.025348828 | 80.98% | 19.02% | 24.57% | 0.20 | 0.05 |
| B9 | V66_C25V_F213M_Y216A | 0.020269342 | 0.006216087 | 0.026485429 | 76.53% | 23.47% | 25.67% | 0.20 | 0.06 |
| B6 | V42_D166E_S177Y_S214F | 0.020183455 | 0.00639037 | 0.026573825 | 75.95% | 24.05% | 25.76% | 0.20 | 0.06 |
| C3 | V19_V49L_S214R_V271E | 0.020011681 | 0.005344673 | 0.025356354 | 78.92% | 21.08% | 24.58% | 0.19 | 0.05 |
| H10 | V80_M162A_N173D_S214F | 0.024048372 | 0.006971313 | 0.031019685 | 77.53% | 22.47% | 24.80% | 0.19 | 0.06 |
| D1 | V4_K118Q_Q161W_S214F | 0.01975402 | 0.011212195 | 0.030966215 | 63.79% | 36.21% | 30.01% | 0.19 | 0.11 |

TABLE 60-continued

| Analysis of ORF2 mutants and WT ORF2 based on production of 3-DOA from OA and DMAPP | | | | | | | | | |
|---|---|---|---|---|---|---|---|---|---|
| CLONE | Mutations | nMol 3-DOA | nMol 5-DOA | nMol Total Products | % 3-DOA | % 5-DOA | % Activity | 3-DOA Production | 5-DOA Production |
| B4 | V26_A53E_A1O8G_K118N | 0.019238697 | 0.01603402 | 0.035272717 | 54.54% | 45.46% | 34.19% | 0.19 | 0.16 |
| G11 | V87_S177W_Y288H_V294N | 0.023189501 | 0.002904714 | 0.026094215 | 88.87% | 11.13% | 20.86% | 0.19 | 0.02 |
| B11 | V82_V49S_K119D_F213M | 0.018465714 | 0.004531353 | 0.022997067 | 80.30% | 19.70% | 22.29% | 0.18 | 0.04 |
| G5 | V39_A53T_K118N_S214F | 0.022330631 | 0.05054202 | 0.07287265 | 30.64% | 69.36% | 58.26% | 0.18 | 0.40 |
| B8 | V58_K118Q_L174V_R228Q | 0.01829394 | 0.006680842 | 0.024974781 | 73.2%5 | 26.75% | 24.21% | 0.18 | 0.06 |
| C12 | V91_N173D_F213M_V294F | 0.017692731 | 0.011909326 | 0.029602057 | 59.77% | 40.23% | 28.69% | 0.17 | 0.12 |
| B2 | V10_V49A_S177Y_C209G | 0.017435069 | 0.006505596 | 0.023941628 | 72.82% | 27.18% | 23.20% | 0.17 | 0.06 |
| B10 | V74_M106E_Y121W_D166E | 0.017177408 | 0.004357071 | 0.021534479 | 79.77% | 20.23% | 20.87% | 0.17 | 0.04 |
| H6 | V48_V49L_E112D_8G26E | 0.02061289 | 0.003485657 | 0.024098546 | 85.54% | 14.46% | 19.27% | 0.16 | 0.03 |
| F8 | V62_A53T_N173D_S214R | 0.02061289 | 0.002323771 | 0.022936661 | 89.87% | 10.13% | 18.34% | 0.16 | 0.02 |
| B5 | V34_A53Q_Y121W_A232S | 0.016662086 | 0.009411273 | 0.026073593 | 63.90% | 36.10% | 25.27% | 0.16 | 0.09 |
| A8 | V57_C25V_A232S_V271E | 0.016490312 | 0.009469367 | 0.025959679 | 63.52% | 36.48% | 25.16% | 0.16 | 0.09 |
| G10 | V79_V49A_Y121W_C230S | 0.01975402 | 0.002904714 | 0.022658733 | 87.18% | 12.82% | 18.11% | 0.16 | 0.02 |
| D05 | V36_F123H_L274V_L298A | 0.012883056 | 0.009876027 | 0.022759083 | 56.61% | 43.39% | 25.94% | 0.15 | 0.11 |
| D10 | V76_V49A_F123A_Y288H | 0.018036279 | 0.004647542 | 0.022683821 | 79.51% | 20.49% | 18.13% | 0.14 | 0.04 |
| D7 | V52_K119A_S214G_L298A | 0.018036279 | 0.003485657 | 0.021521935 | 83.80% | 16.20% | 17.21% | 0.14 | 0.03 |
| F10 | V78_K119D_Q161W_L298Q | 0.018036279 | 0.003485657 | 0.021521935 | 83.80% | 16.20% | 17.21% | 0.14 | 0.03 |
| G08 | V63_F123W_M162F_C209G | 0.018036279 | 0.002904714 | 0.020940992 | 86.13% | 13.87% | 16.74% | 0.14 | 0.02 |
| H8 | V64_M106E_M162A_Y216A | 0.014600797 | 0.004647542 | 0.019248339 | 75.85% | 24.15% | 18.69% | 0.14 | 0.05 |
| C2 | V11_K118N_K119A_V271E | 0.014429023 | 0.004415165 | 0.018844188 | 76.57% | 23.43% | 18.26% | 0.14 | 0.04 |
| D9 | V68_K118N_C209G_R228Q | 0.017177408 | 0.004066599 | 0.021244008 | 80.86% | 19.14% | 16.98% | 0.14 | 0.03 |
| G2 | V15_A53E_F213M_2R28Q | 0.017177408 | 0.002904714 | 0.020082122 | 85.54% | 14.46% | 16.05% | 0.14 | 0.02 |
| D8 | V60_E112D_K119A_N173D | 0.016318538 | 0.004066599 | 0.020385137 | 80.05% | 19.95% | 16.30% | 0.13 | 0.03 |
| D8 | V60_E112D_K119A_N173D | 0.016318538 | 0.001742828 | 0.018061366 | 90.35% | 9.65% | 14.44% | 0.13 | 0.01 |
| G7 | V55_V49S_Y216A_V294N | 0.014600797 | 0.002904714 | 0.017505511 | 83.41% | 16.59% | 13.99% | 0.12 | 0.02 |
| F12 | V94_A17T_V49A_C230N | 0.014600797 | 0.002323771 | 0.016924568 | 86.27% | 13.73% | 13.53% | 0.12 | 0.02 |
| G6 | V47_K118Q_F123A_R228E | 0.013741927 | 0.002323771 | 0.016066985 | 85.54% | 14.46% | 12.84% | 0.11 | 0.02 |
| G4 | V31_D227E_R228E_L298Q | 0.012883056 | 0.001742828 | 0.014625884 | 88.08% | 11.92% | 11.69% | 0.10 | 0.01 |

Figure 73:
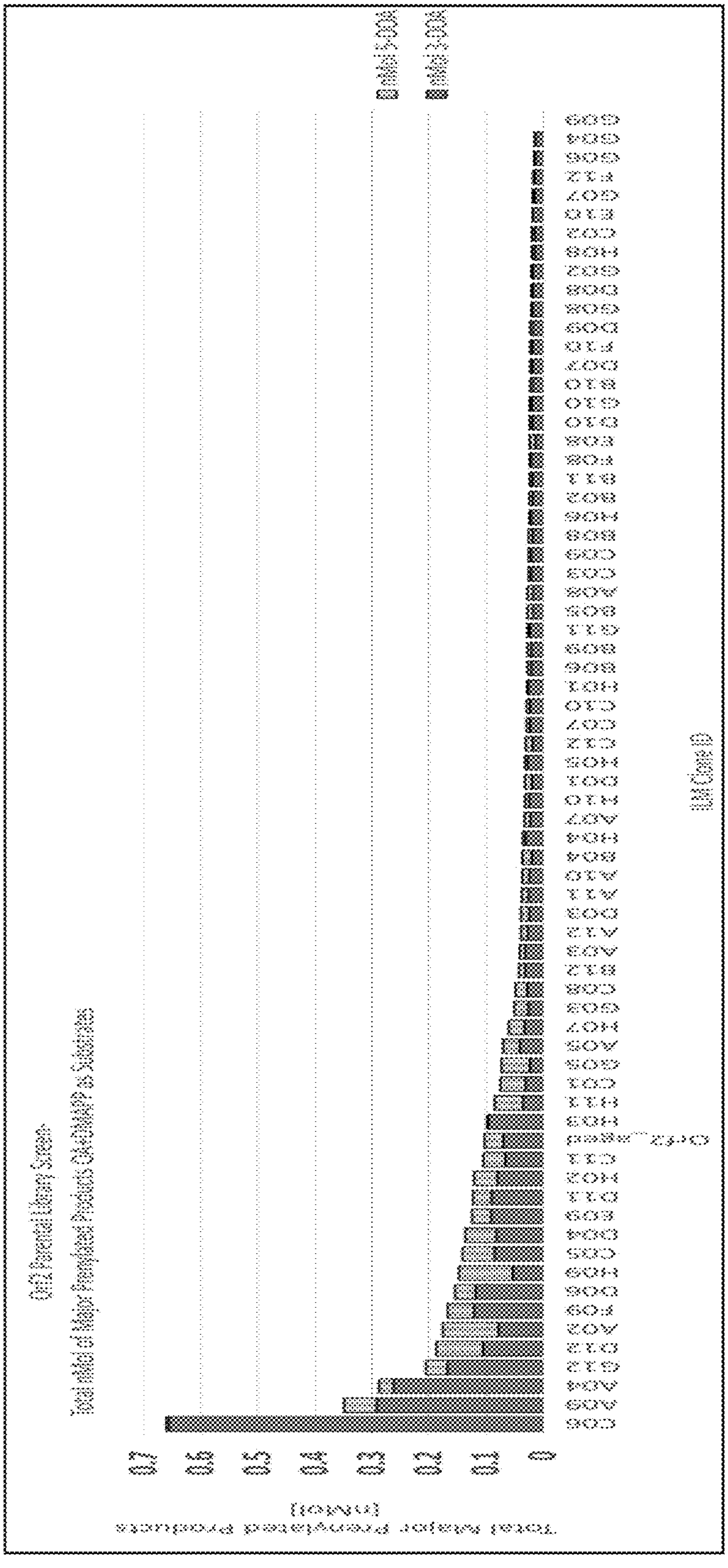
FIG. 73: Total nMol of prenylated products produced by ORF2 triple mutants using OA as substrate and DMAPP as donor

The amount of 3-DOA or 5-DOA (in nMols) generated by each of the ORF2 triple mutant clones was measured using HPLC. FIG. 73 shows the total nMols of prenylated products generated using OA as substrate and DMAPP as donor by each of the ORF2 triple mutants, and the proportion of 3-DOA and 5-DOA within the total amount of prenylated products. An exemplary Wild Type ORF2 replicate is included in the graph for comparison purposes.

Figure 74:
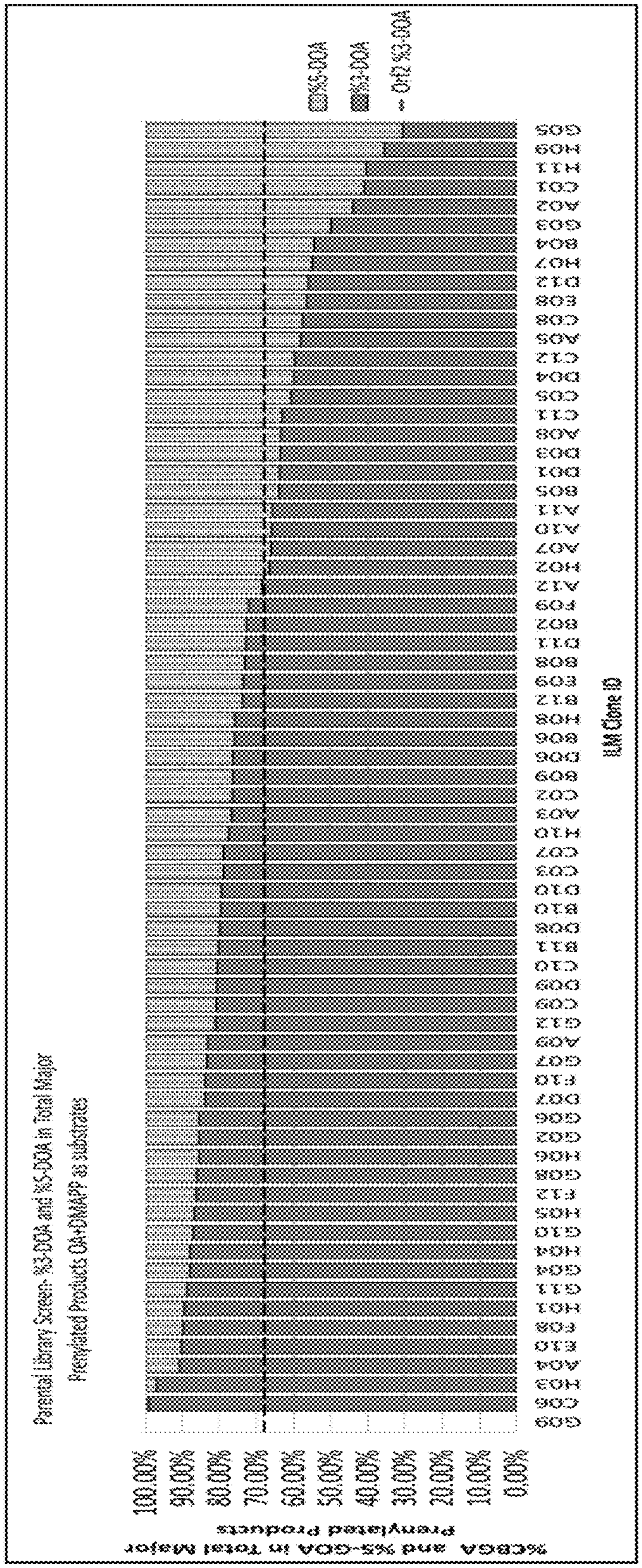
FIG. 74: % 3-DOA produced by ORF2 triple mutants using OA as substrate and DMAPP as donor

FIG. 74 shows the %3-DOA within the total prenylated products produced by each of the ORF2 triple mutant clones using OA as substrate and DMAPP as donor. In this graph, the mutant clones are ordered based on decreasing %3-DOA (from left to right) they produce, with the %5-DOA depicted in red. The black threshold line on the graph indicates the %3-DOA that is produced by the wild type enzyme.

Figure 75:
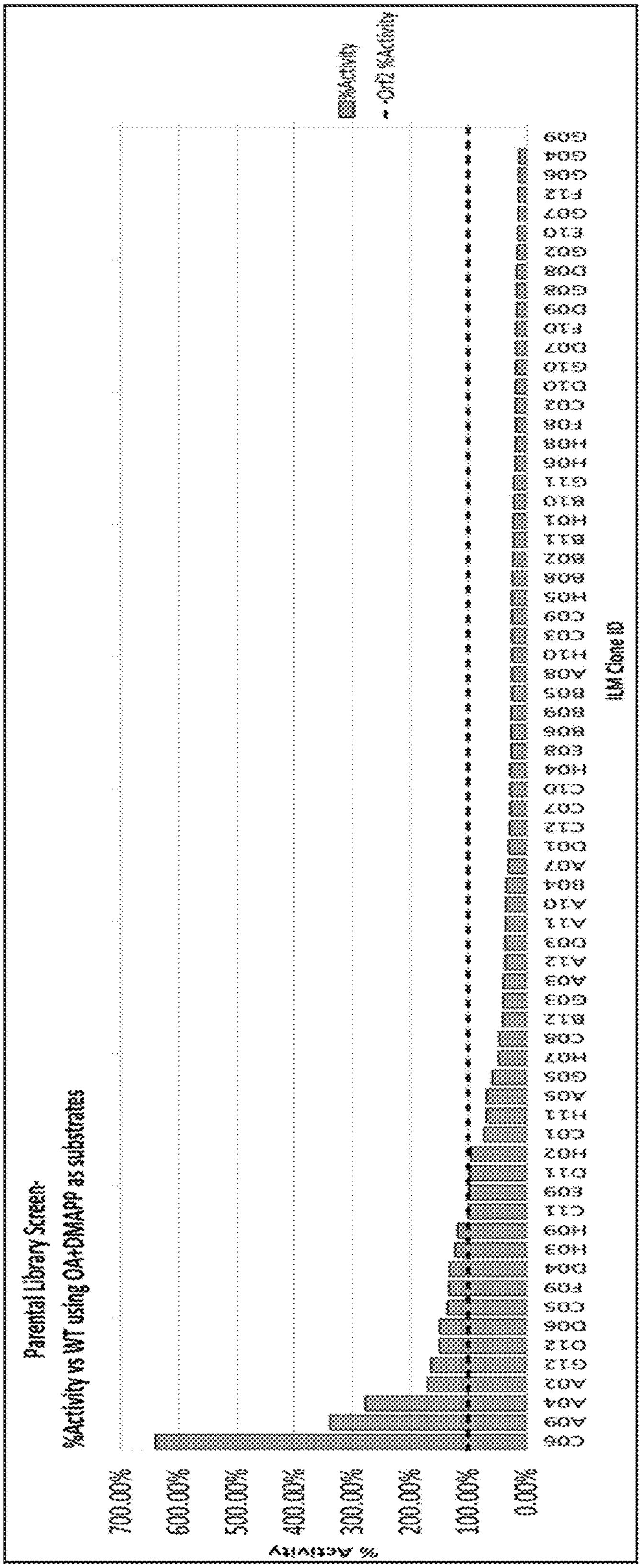
FIG. 75: % enzymatic activity of ORF2 triple mutants using OA as substrate and DMAPP as donor

FIG. 75 shows the ORF2 enzymatic activity (using OA as substrate and DMAPP as donor) of each of the triple mutant ORF2 clones relative to the wild type enzyme. % activity was calculated by dividing the nMols of total prenylated products produced by a mutant by the nMols of total prenylated products produced by the wild type control, and expressed as a percentage. The red threshold line is the wild type Orf2% activity.

Figure 76:
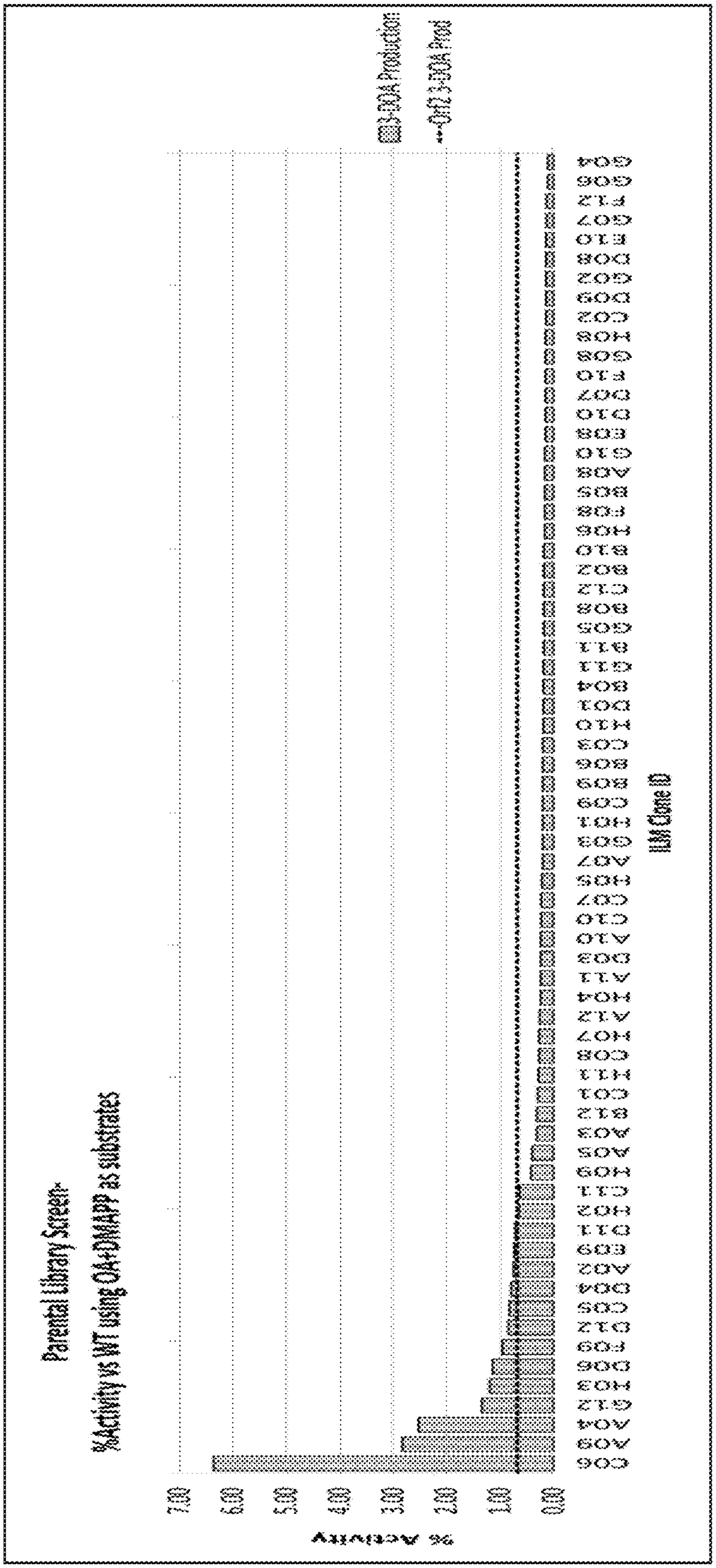
FIG. 76: 3-DOA production potential of ORF2 triple mutants using OA as substrate and DMAPP as donor

FIG. 76 shows the 3-DOA production potential of each of the ORF2 triple mutant clones when using OA as substrate and DMAPP as donor. 3-DOA production potential (interchangeably referred to herein as 3-DOA production quotient) represents the improvement in 3-DOA production vs. the wild type enzyme. 3-DOA production potential was calculated by multiplying the % 3-DOA by the % activity of each mutant. For instance, a wild type ORF2, which makes ~20% 3-DOA, and has an activity of 100%, would have a 3-DOA Production Potential of 0.2. The red threshold line on the graph represents this wild type value of 0.2.

While the 3-DOA production potential analysis shown in FIG. 76 is useful to rank ORF2 mutant clones based on the amount of 3-DOA produced, such an analysis would not differentiate between a mutant that made 100% 3-DOA but was 20% as active as wild-type ORF2; or a mutant that made 10% 3-DOA and was 200% as active as wild type ORF2. Therefore, we employed a cluster analysis by plotting the 3-DOA Production Potential vs. %5-DOA (FIG. 77). %5-DOA was calculated in a similar manner as %3-DOA. We used the top 16 mutants ranked based on their 3-DOA production potential for this analysis. High 5-DOA producing mutants cluster together towards the right of the graph and high 3-DOA producing mutants cluster towards the left of the graph.

Figure 77:
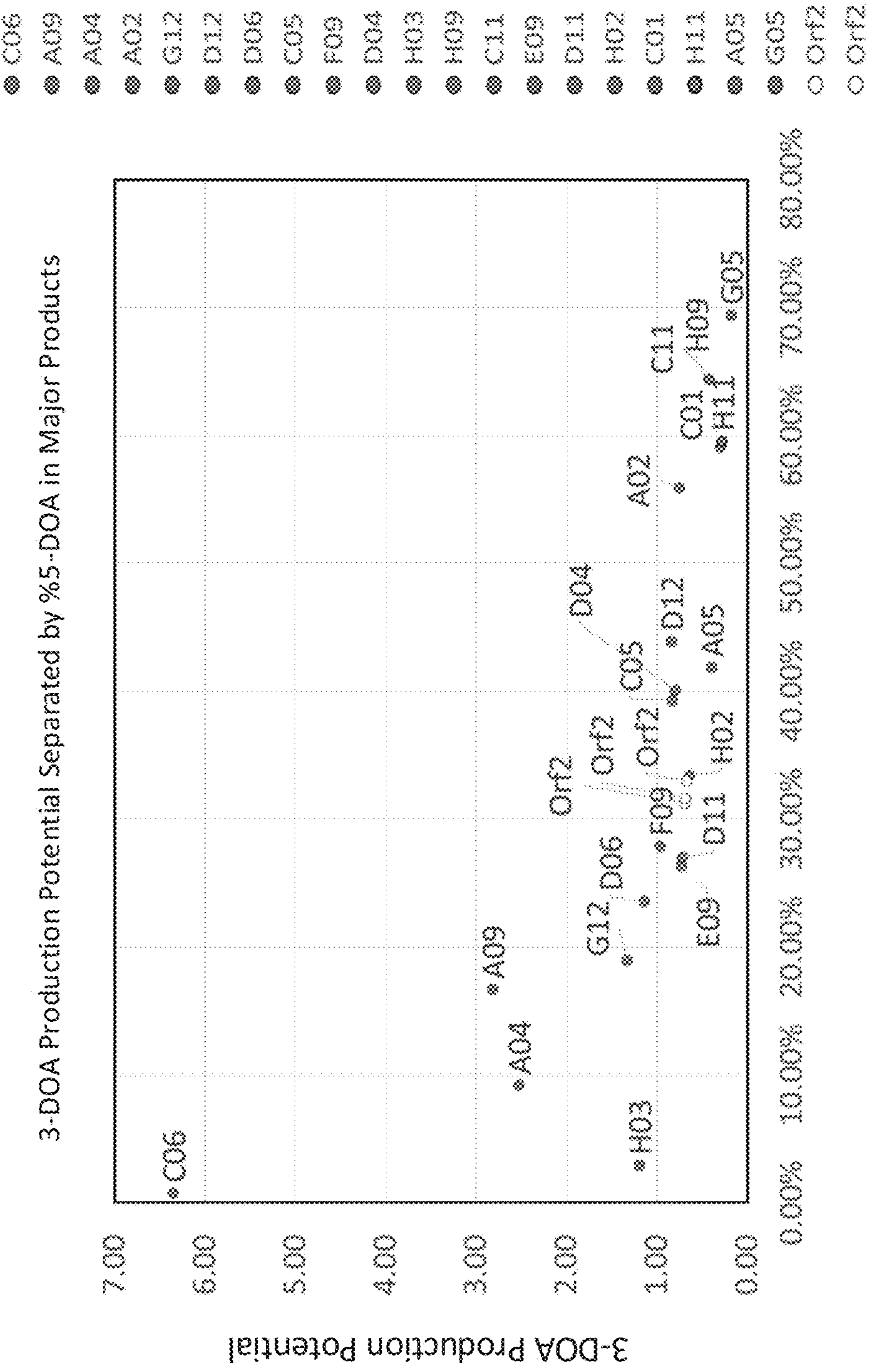
FIG. 77: Cluster map of ORF2 triple mutants clustered based on 3-DOA production potential and %5-DOA produced, using OA as substrate and DMAPP as donor

Based on the analysis performed in FIG. 77, 10 mutants which cluster to the left of the graph were selected (Table 61). These clones were targeted for "breakdown" analysis. Breakdown analysis involves breaking a parent triple mutant into all pair wise doubleton combinations of mutations as well as all singleton mutations that make up the parental clone. For each parental clone targeted six unique mutants are generated (3 doubles and 3 singles).

Breakdown analysis for these triple mutants will be performed as described above in Example 34. The singleton and double mutants resulting from the breakdown of these mutants will be analyzed to determine the total amount of prenylated products (and the respective proportion of 5-DOA and 3-DOA); and %3-DOA within the prenylated products produced by these mutants.

Further, based on the analysis of the breakdown mutants, amino acid sites will be selected for targeted amino acid site saturation mutagenesis, as described above in Example 34; and mutants that have significantly higher 3-DOA production potential and/or the total amount of prenylated products, as compared to WT ORF2, will be identified. Finally, ORF2 stacking mutants that carry different novel combinations of the mutations identified by the analysis as being important for ORF2's enzymatic activity will be generated. These stacking mutants will further be analyzed to determine their % enzymatic activity, %3-DOA, %5-DOA and 3-DOA production potential.

Example 36—Proton NMR Signals of Selected Compounds

Figure 84A:
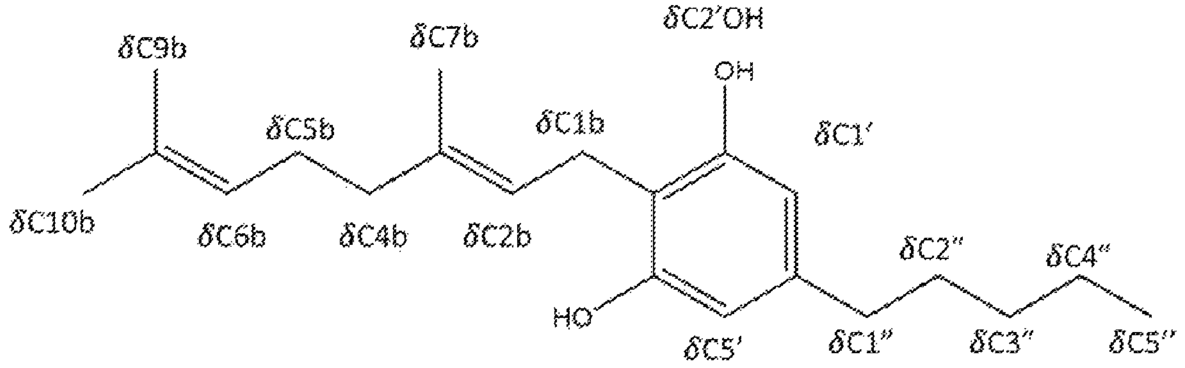
FIGS. 84A-K: Proton NMR signals obtained in DMSO at 600 MHz for the following compounds: RBI-01 (FIG. 84A); RBI-02 (FIG. 84B); RBI-03 (FIG. 84C); RBI-04 (FIG. 84D); RBI-05 (FIG. 84E); RBI-07 (FIG. 84F); RBI-08 (FIG. 84G); RBI-09 (FIG. 84H); RBI-10 (FIG. 84I); RBI-11 (FIG. 84J); and RBI-12 (FIG. 84K).
Figure 84B:
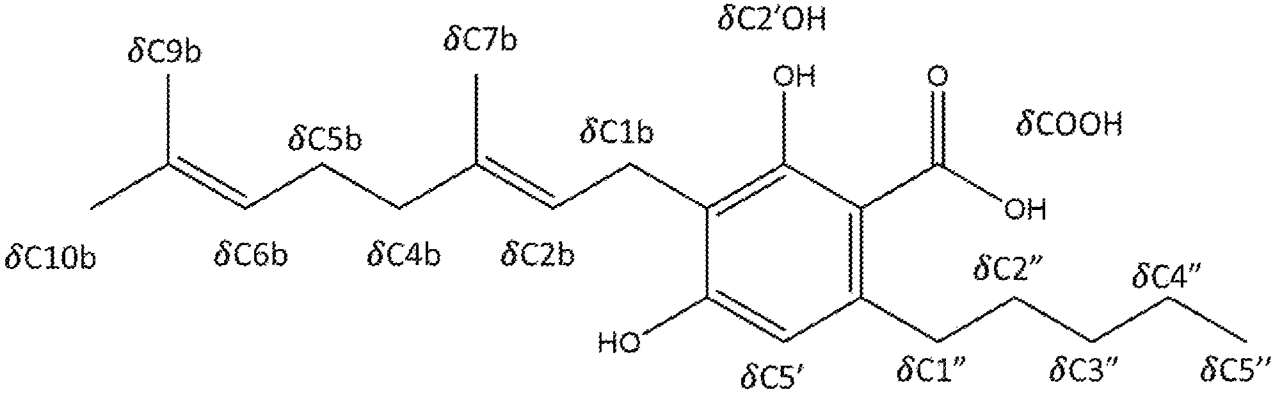
Figure 84C:
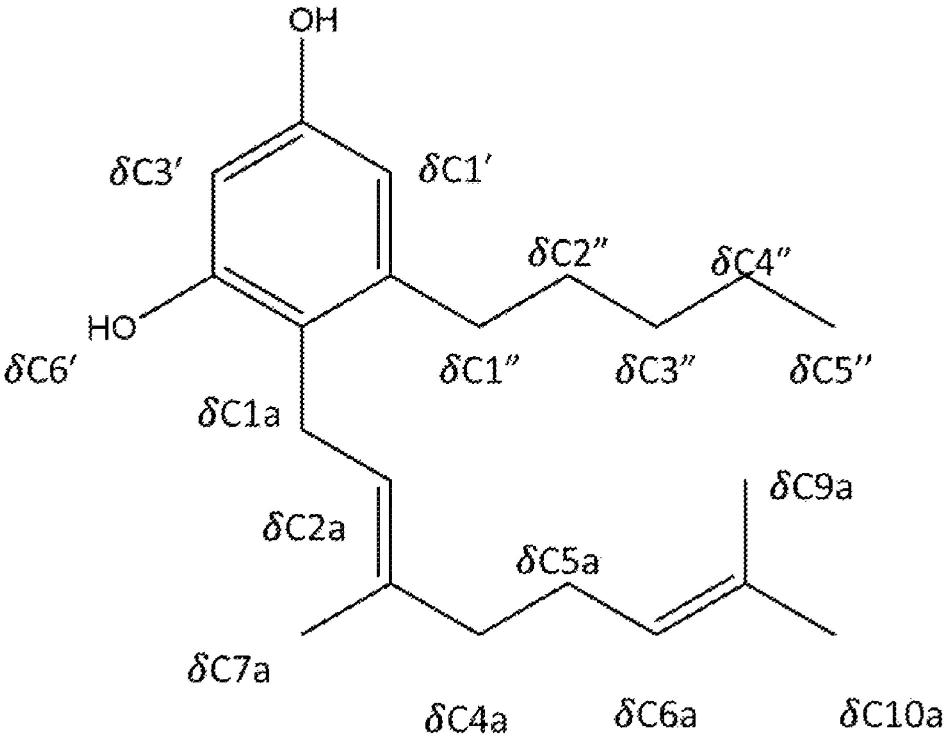
Figure 84D:
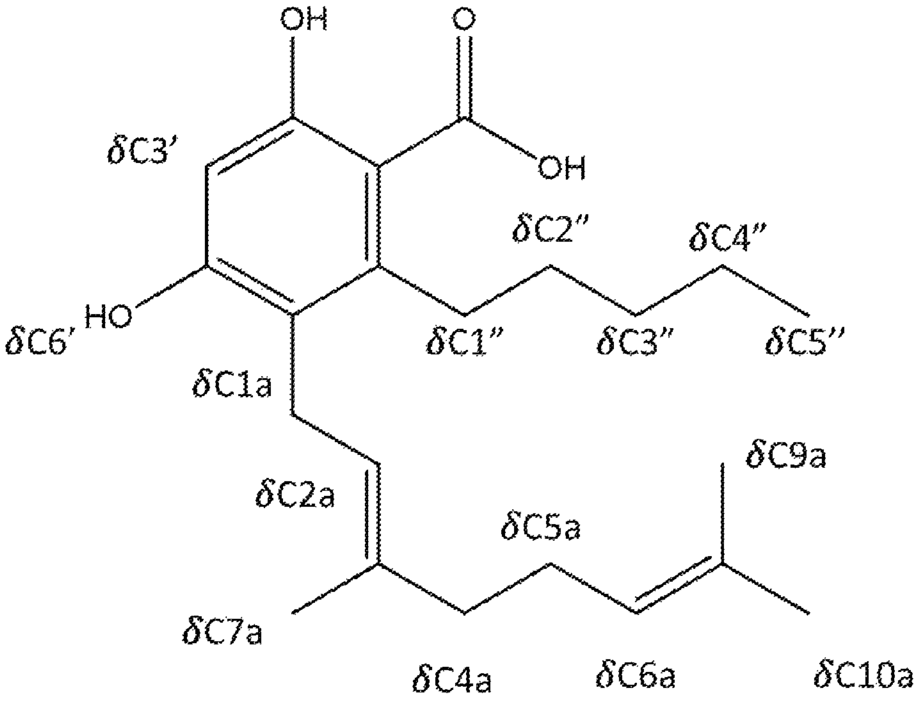
Figure 84E:
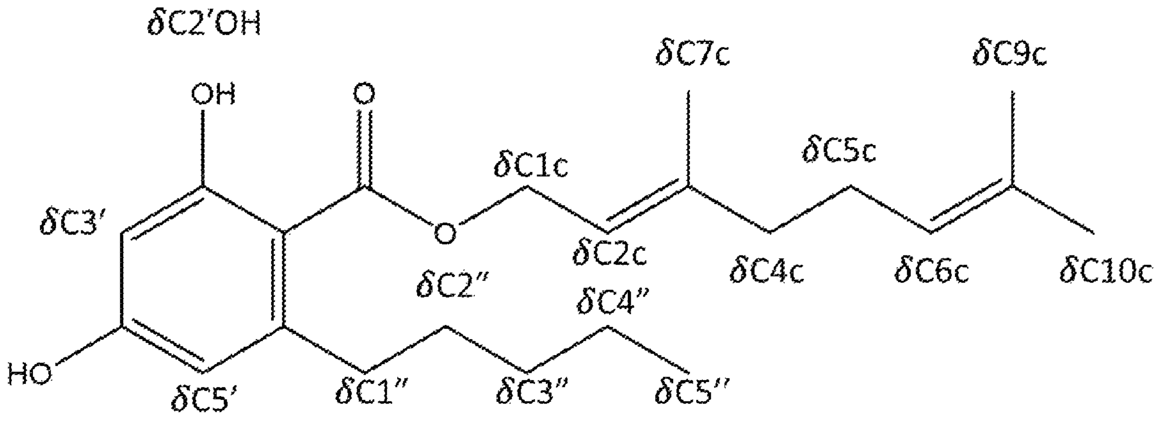
Figure 84F:
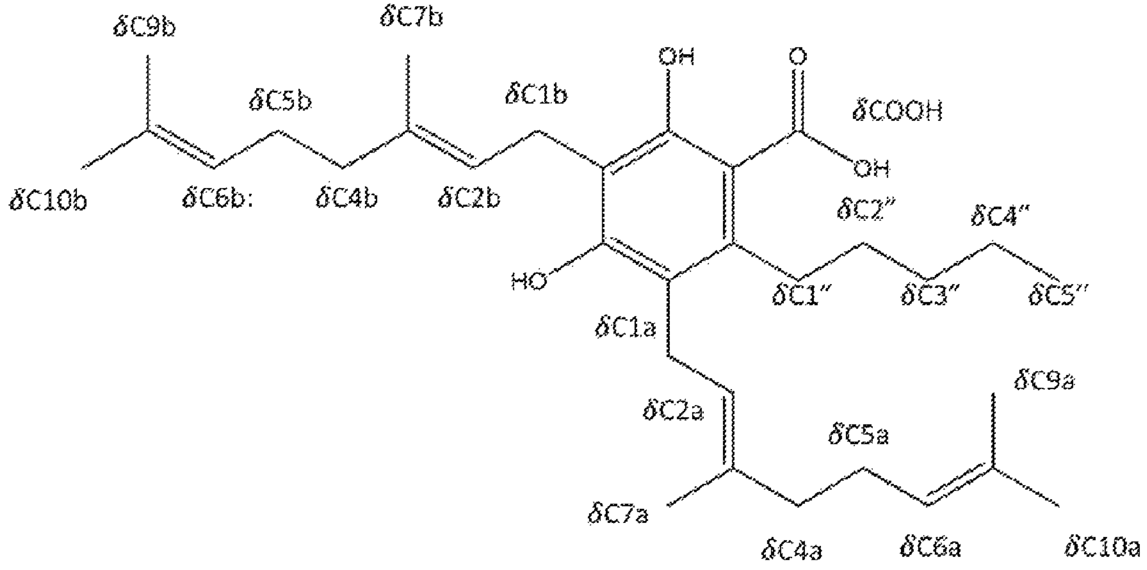
Figure 84G:
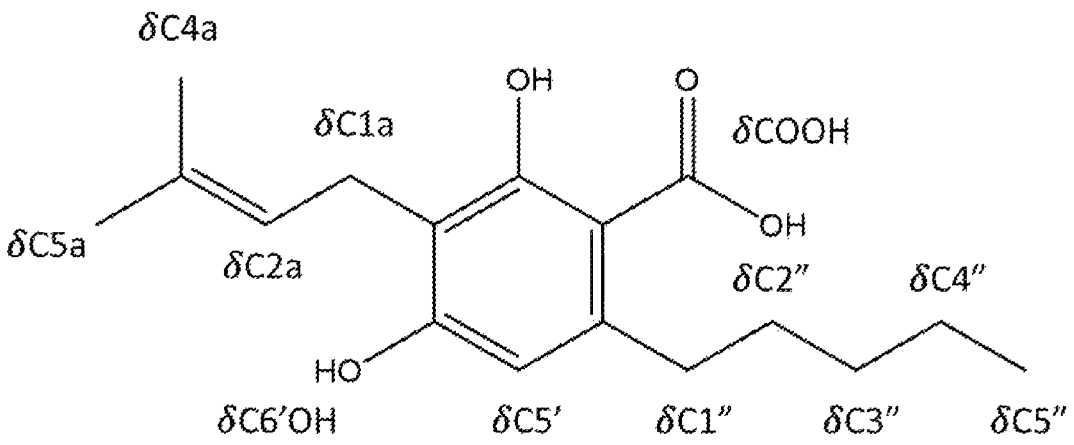
Figure 84H:
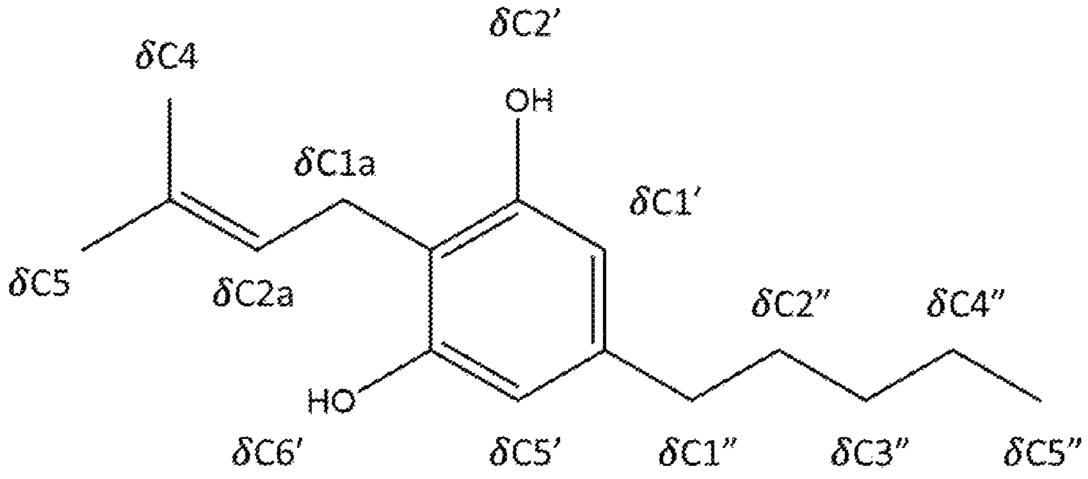
Figure 84I:
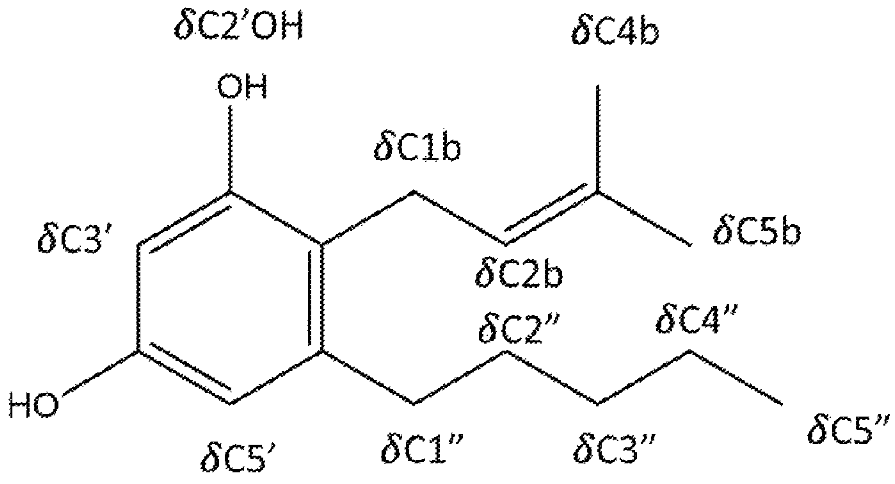
Figure 84J:
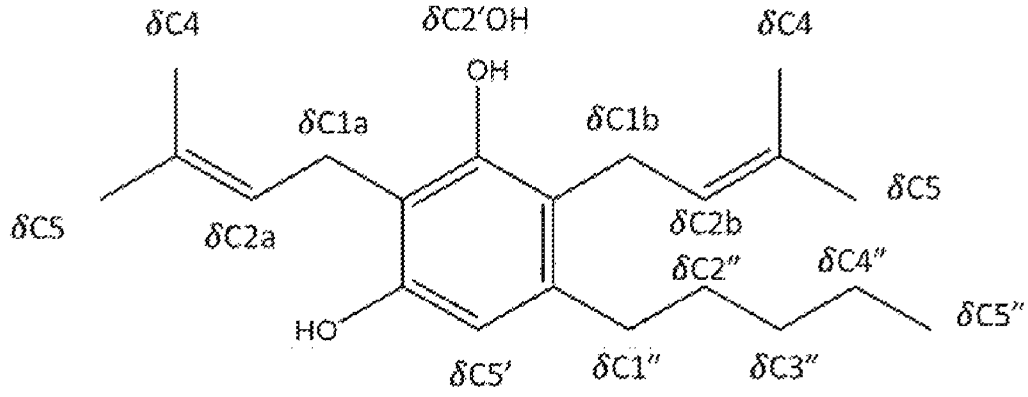
Figure 84K:
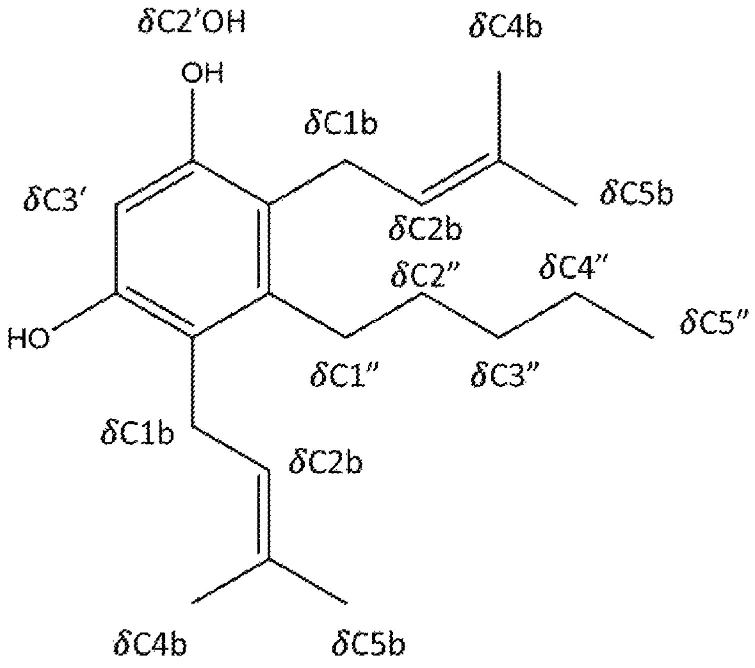

The Proton NMR signals of selected compound were obtained in DMSO at 600 MHz and the proton NMR assignments of these compounds were shown in FIGS. 84A-84K, including RBI-01 (FIG. 84A); RBI-02 (FIG. 84B); RBI-03 (FIG. 84C); RBI-04 (FIG. 84D); RBI-05 (FIG. 84E); RBI-07 (FIG. 84F); RBI-08 (FIG. 84G); RBI-09 (FIG. 84H); RBI-10 (FIG. 84I); RBI-11 (FIG. 84J); and RBI-12 (FIG. 84K).

TABLE 61

Clones targeted for breakdown analysis based on 3-DOA production potential and %5-DOA produced, using OA as substrate and DMAPP as donor

| 3-DOA Production Rank | Clone ID | Mutations | Targeted for Breakdown |
|---|---|---|---|
| 1 | C6 | V43_Q161A_M162F_Q295A | YES |
| 2 | A9 | V65_V49A_Q161S_V294A | YES |
| 3 | A4 | V25_L219F_V294N_Q295A | YES |
| 4 | A2 | V9_Q38G_E112D_F123H | NO-HIGH 5-DOA CLUSTER |
| 5 | G12 | V95_A17T_Q161W_A232S | YES |
| 6 | D12 | V92_A53T_E112D_G205M | NO-MIDDLE 5-DOA CLUSTER |
| 7 | D6 | V44_A53E_Q161A_V294N | YES |
| 8 | C5 | V35_A53Q_S177Y_Y288H | NO-MIDDLE 5-DOA CLUSTER |
| 9 | F9 | V70_Q38G_D166E_Q295A | YES |
| 10 | D4 | V28_A53T_D166E_Q295W | NO-MIDDLE 5-DOA CLUSTER |
| 11 | H03 | V24_A17T_F213M_S214R | YES |
| 12 | H9 | V72_E112G_G205M_L298W | NO-HIGH 5-DOA CLUSTER |
| 13 | C11 | V83_E112D_L219F_V294F | NO-HIGH 5-DOA CLUSTER |
| 14 | E9 | V69_A53T_M106E_Q161S | YES |
| 15 | D11 | V84_F123H_L174V_S177E | YES |
| 16 | H2 | V16_A53Q_S177W_L219F | NO-WT CLUSTER |
| 17 | C1 | V3_V49S_M162A_Y283L | NO-HIGH 5-DOA CLUSTER |
| 18 | H11 | V88_A108G_Q161S_G205M | NO-HIGH 5-DOA CLUSTER |
| 19 | A5 | V33_A17T_C25V_E112G | NO-MIDDLE 5-DOA CLUSTER |
| 20 | G5 | V39_A53T_K118N_S214F | YES-HIGH 5-DOA CLUSTER REPRESENTATIVE |

SEQUENCE LISTING (604 sequences)

SEQ ID NO: 1 - protein, 307 aa, Unknown [sequence omitted]

SEQ ID NO: 2 - protein, 307 aa, Artificial Sequence
  ORF2 (NphB) recombinant mutant A108G, Q295N, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGQLKAFDSLED

SEQ ID NO: 3 - protein, 307 aa, Artificial Sequence
  ORF2 (NphB) recombinant mutant K119A, Q161S, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKATYAFFPTDNMPGVAELSAIPSMPPAVAENAELFARYGLDKVSMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 4 - protein, 307 aa, Artificial Sequence
  ORF2 (NphB) recombinant mutant V49S, M162A, Y283L
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 5 - protein, 307 aa, Artificial Sequence
  ORF2 (NphB) recombinant mutant K118Q, Q161W, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVWMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 6 - protein, 307 aa, Artificial Sequence
  ORF2 (NphB) recombinant mutant Q161A, S214G, V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 7 - protein, 307 aa, Artificial Sequence
  ORF2 (NphB) recombinant mutant F123W, S177W, G286E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 8 - protein, 307 aa, Artificial Sequence
  ORF2 (NphB) recombinant mutant K118N, N173D, Q295N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVDLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 9 - protein, 307 aa, Artificial Sequence
  ORF2 (NphB) recombinant mutant K119A, Q161A, R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKATYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 10 - protein, 307 aa, Artificial Sequence
  ORF2 (NphB) recombinant mutant Q38G, E112D, F123H
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGDVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 11 - protein, 307 aa, Artificial Sequence
  ORF2 (NphB) recombinant mutant V49A, S177Y, C209G
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFGKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 12 - protein, 307 aa, Artificial Sequence
  ORF2 (NphB) recombinant mutant K118N, K119A, V271E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNATYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLEYGLTLSPKEEYYKLGAYYHITDVQRGLLKAFDSLED

SEQ ID NO: 13 - protein, 307 aa, Artificial Sequence
  ORF2 (NphB) recombinant mutant L174V, C230N, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLNFAVISNDPTLVPSSDEGDIEKFHNYATKAPYAYVGEKRTLVYGLTLSPKEEYYKLGAYYHITDVQRGQLKAFDSLED

SEQ ID NO: 14 - protein, 307 aa, Artificial Sequence
  ORF2 (NphB) recombinant mutant K119D, S177E, L219F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFEELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 15 - protein, 307 aa, Artificial Sequence
  ORF2 (NphB) recombinant mutant A53E, E112G, R228E
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 16 - protein, 307 aa, Artificial Sequence
  ORF2 (NphB) recombinant mutant A53E, F213M, R228Q
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSMSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 17 - protein, 307 aa, Artificial Sequence
  ORF2 (NphB) recombinant mutant A53Q, S177W, L219F
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 18 - protein, 307 aa, Artificial Sequence
  ORF2 (NphB) recombinant mutant F123A, Y283L
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 19 - protein, 307 aa, Artificial Sequence
  ORF2 (NphB) recombinant mutant C25V, Y121W, M162F
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 20 - protein, 307 aa, Artificial Sequence
  ORF2 (NphB) recombinant mutant V49L, S214R, V271E
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLEYGLTLSPKEEYYKLGAYYHITDVQRGLLKAFDSLED

SEQ ID NO: 21 - protein, 307 aa, Artificial Sequence
  ORF2 (NphB) recombinant mutant D227E, C230N, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIERLNFAVISNDPTLVPSSDEGDIEKFHNYATKAPYAYVGEKRTLVYGLTLSPKEEYYKLGAYYHITDVWRGLLKAFDSLED

SEQ ID NO: 22 - protein, 307 aa, Artificial Sequence
  ORF2 (NphB) recombinant mutant G205L, Y216A, C230S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVAPTLNWETGKIDRLSFAVISNDPTLVPSSDEGDIEKFHNYATKAPYAYVGEKRTLVYGLTLSPKEEYYKLGAYYHITDVQRGLLKAFDSLED

SEQ ID NO: 23 - protein, 307 aa, Artificial Sequence
  ORF2 (NphB) recombinant mutant Q161S, V294F, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDFQRGWLKAFDSLED

SEQ ID NO: 24 - protein, 307 aa, Artificial Sequence
  ORF2 (NphB) recombinant mutant L219F, Y283L, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYLKLGAYYHITDVQRGWLKAFDSLED

SEQ ID NO: 25 - protein, 307 aa, Artificial Sequence
  ORF2 (NphB) recombinant mutant A17T, F213M, S214R
MSEAADVERVYAAMEETAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSMRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 26 - protein, 307 aa, Artificial Sequence
  ORF2 (NphB) recombinant mutant L219F, V294N, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDNARGLLKAFDSLED

SEQ ID NO: 27 - protein, 307 aa, Artificial Sequence
  ORF2 (NphB) recombinant mutant A53E, A108G, K118N
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFGIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 28 - protein, 307 aa, Artificial Sequence
  ORF2 (NphB) recombinant mutant Q38G, E112G, M162F
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 29 - protein, 307 aa, Artificial Sequence
  ORF2 (NphB) recombinant mutant A53T, D166E, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 30 - protein, 307 aa, Artificial Sequence
  ORF2 (NphB) recombinant mutant L174V, C230S, V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLSFAVISNDPTLVPSSDEGDIEKFHNYATKAPYAYVGEKRTLVYGLTLSPKEEYYKLGAYYHITDAQRGLLKAFDSLED

SEQ ID NO: 31 - protein, 307 aa, Artificial Sequence
  ORF2 (NphB) recombinant mutant M106E, G286E, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGWLKAFDSLED

SEQ ID NO: 32 - protein, 307 aa, Artificial Sequence
  ORF2 (NphB) recombinant mutant D227E, R228E, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIEELCFAVISNDPTLVPSSDEGDIEKFHNYATKAPYAYVGEKRTLVYGLTLSPKEEYYKLGAYYHITDVQRGQLKAFDSLED

SEQ ID NO: 33 - protein, 307 aa, Artificial Sequence
  ORF2 (NphB) recombinant mutant M162A, C209G, Y288H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFGKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 34 - protein, 307 aa, Artificial Sequence
  ORF2 (NphB) recombinant mutant A17T, C25V, E112G
MSEAADVERVYAAMEETAGLLGVAVARDKIYPLLSTFQDTLVEGGSVVVFSMASGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 35 - protein, 307 aa, Artificial Sequence
  ORF2 (NphB) recombinant mutant A53Q, Y121W, A232S
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 36 - protein, 307 aa, Artificial Sequence
  ORF2 (NphB) recombinant mutant A53Q, S177Y, Y288H
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 37 - protein, 307 aa, Artificial Sequence
  ORF2 (NphB) recombinant mutant F123H, L274V, L298A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVQRGALKAFDSLED

SEQ ID NO: 38 - protein, 307 aa, Artificial Sequence
  ORF2 (NphB) recombinant mutant S177W, S214F, Y283L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 39 - protein, 307 aa, Artificial Sequence
  ORF2 (NphB) recombinant mutant A53E, G205M, L274V
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGVTLSPKEEYYKLGAYYHITDVQRGLLKAFDSLED

SEQ ID NO: 40 - protein, 307 aa, Artificial Sequence
  ORF2 (NphB) recombinant mutant A53T, K118N, S214F
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 41 - protein, 307 aa, Artificial Sequence
  ORF2 (NphB) recombinant mutant S177E, S214R, R228E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFEELSAQTLEAESVLALVRELGLHVPNELGLKFCKRSFRVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 42 - protein, 307 aa, Artificial Sequence
  ORF2 (NphB) recombinant mutant K118Q, S177Y, D227E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIERLCFAVISNDPTLVPSSDEGDIEKFHNYATKAPYAYVGEKRTLVYGLTLSPKEEYYKLGAYYHITDVQRGLLKAFDSLED

SEQ ID NO: 43 - protein, 307 aa, Artificial Sequence
  ORF2 (NphB) recombinant mutant D166E, S177Y, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFYELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 44 - protein, 307 aa, Artificial Sequence
  ORF2 (NphB) recombinant mutant Q161A, M162F, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 45 - protein, 307 aa, Artificial Sequence
  ORF2 (NphB) recombinant mutant A53E, Q161A, V294N
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 46 - protein, 307 aa, Artificial Sequence
  ORF2 (NphB) recombinant mutant A108G, F123W, V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAWFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 47 - protein, 307 aa, Artificial Sequence
  ORF2 (NphB) recombinant mutant A53Q, G205L, Q295N
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 48 - protein, 307 aa, Artificial Sequence
  ORF2 (NphB) recombinant mutant K118Q, F123A, R228E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 49 - protein, 307 aa, Artificial Sequence
  ORF2 (NphB) recombinant mutant V49L, E112D, G286E
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGDVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 50 - protein, 307 aa, Artificial Sequence
  ORF2 (NphB) recombinant mutant G205L, R228E, C230N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVYPTLNWETGKIDELNFAVISNDPTLVPSSDEGDIEKFHNYATKAPYAYVGEKRTLVYGLTLSPKEEYYKLGAYYHITDVQRGLLKAFDSLED

SEQ ID NO: 51 - protein, 307 aa, Artificial Sequence
  ORF2 (NphB) recombinant mutant M162A, D227E, C230S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVYPTLNWETGKIERLSFAVISNDPTLVPSSDEGDIEKFHNYATKAPYAYVGEKRTLVYGLTLSPKEEYYKLGAYYHITDVQRGLLKAFDSLED

SEQ ID NO: 52 - protein, 307 aa, Artificial Sequence
  ORF2 (NphB) recombinant mutant V49L, K119D, G205M
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 53 - protein, 307 aa, Artificial Sequence
  ORF2 (NphB) recombinant mutant K119A, S214G, L298A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKATYAFFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGALKAFDSLED

SEQ ID NO: 54 - protein, 307 aa, Artificial Sequence
  ORF2 (NphB) recombinant mutant Q38G, Y216A, A232S
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVAPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 55 - protein, 307 aa, Artificial Sequence
  ORF2 (NphB) recombinant mutant Q161A, V271E, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLEYGLTLSPKEEYYKLGAYYHITDVWRGLLKAFDSLED

SEQ ID NO: 56 - protein, 307 aa, Artificial Sequence
  ORF2 (NphB) recombinant mutant V49S, Y216A, V294N
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVAPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 57 - protein, 307 aa, Artificial Sequence
  ORF2 (NphB) recombinant mutant F123A, M162F, S214G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQFTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 58 - protein, 307 aa, Artificial Sequence
  ORF2 (NphB) recombinant mutant C25V, A232S, V271E
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLEYGLTLSPKEEYYKLGAYYHITDVQRGLLKAFDSLED

SEQ ID NO: 59 - protein, 307 aa, Artificial Sequence
  ORF2 (NphB) recombinant mutant K118Q, L174V, R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 60 - protein, 307 aa, Artificial Sequence
  ORF2 (NphB) recombinant mutant V49S, S214G, V294A
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 61 - protein, 307 aa, Artificial Sequence
  ORF2 (NphB) recombinant mutant E112D, K119A, N173D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGDVTGGFKATYAFFPTDNMPGVAELSAIPSMPPAVAENAELFARYGLDKVQMTSMDYKKRQVDLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 62 - protein, 307 aa, Artificial Sequence
  ORF2 (NphB) recombinant mutant F123W, Q161W, D227E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIERLCFAVISNDPTLVPSSDEGDIEKFHNYATKAPYAYVGEKRTLVYGLTLSPKEEYYKLGAYYHITDVQRGLLKAFDSLED

SEQ ID NO: 63 - protein, 307 aa, Artificial Sequence
  ORF2 (NphB) recombinant mutant A53T, N173D, S214R
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVDLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 64 - protein, 307 aa, Artificial Sequence
  ORF2 (NphB) recombinant mutant F123W, M162F, C209G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQFTSMDYKKRQVNLYFSELSAQTLEAESVLALVRELGLHVPNELGLKFGKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 65 - protein, 307 aa, Artificial Sequence
  ORF2 (NphB) recombinant mutant M106E, M162A, Y216A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVAPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 66 - protein, 307 aa, Artificial Sequence
  ORF2 (NphB) recombinant mutant V49A, Q161S, V294A
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 67 - protein, 307 aa, Artificial Sequence
  ORF2 (NphB) recombinant mutant C25V, F213M, Y216A
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSMSVAPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 68 - protein, 307 aa, Artificial Sequence
  ORF2 (NphB) recombinant mutant A108G, K119D, L298A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKDTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGALKAFDSLED

SEQ ID NO: 69 - protein, 307 aa, Artificial Sequence
  ORF2 (NphB) recombinant mutant K118N, C209G, R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFGKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 70 - protein, 307 aa, Artificial Sequence
  ORF2 (NphB) recombinant mutant A53T, M106E, Q161S
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 71 - protein, 307 aa, Artificial Sequence
  ORF2 (NphB) recombinant mutant Q38G, D166E, Q295A
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 72 - protein, 307 aa, Artificial Sequence
  ORF2 (NphB) recombinant mutant M106E, G205L, C209G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFGKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 73 - protein, 307 aa, Artificial Sequence
  ORF2 (NphB) recombinant mutant E112G, G205M, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGWLKAFDSLED

SEQ ID NO: 74 - protein, 307 aa, Artificial Sequence
  ORF2 (NphB) recombinant mutant V49S, K118Q, S177E
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 75 - protein, 307 aa, Artificial Sequence
  ORF2 (NphB) recombinant mutant M106E, Y121W, D166E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTWAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 76 - protein, 307 aa, Artificial Sequence
  ORF2 (NphB) recombinant mutant A53Q, L274V, Q295A
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVARGLLKAFDSLED

SEQ ID NO: 77 - protein, 307 aa, Artificial Sequence
  ORF2 (NphB) recombinant mutant V49A, F123A, Y288H
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 78 - protein, 307 aa, Artificial Sequence
  ORF2 (NphB) recombinant mutant C25V, F123H, Q295N
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 79 - protein, 307 aa, Artificial Sequence
  ORF2 (NphB) recombinant mutant K119D, Q161W, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGQLKAFDSLED

SEQ ID NO: 80 - protein, 307 aa, Artificial Sequence
  ORF2 (NphB) recombinant mutant V49A, Y121W, C230S
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLSFAVISNDPTLVPSSDEGDIEKFHNYATKAPYAYVGEKRTLVYGLTLSPKEEYYKLGAYYHITDVQRGLLKAFDSLED

SEQ ID NO: 81 - protein, 307 aa, Artificial Sequence
  ORF2 (NphB) recombinant mutant M162A, N173D, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVDLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 82 - protein, 307 aa, Artificial Sequence
  ORF2 (NphB) recombinant mutant V49L, D166E, L274V
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVQRGLLKAFDSLED

SEQ ID NO: 83 - protein, 307 aa, Artificial Sequence
  ORF2 (NphB) recombinant mutant V49S, K119D, F213M
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFSELSAQTLEAESVLALVRELGLHVPNELGLKFCKRSMSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 84 - protein, 307 aa, Artificial Sequence
  ORF2 (NphB) recombinant mutant E112D, L219F, V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGDVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 85 - protein, 307 aa, Artificial Sequence
  ORF2 (NphB) recombinant mutant F123H, L174V, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNVYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 86 - protein, 307 aa, Artificial Sequence
  ORF2 (NphB) recombinant mutant E112G, F123H, S214G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGGVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 87 - protein, 307 aa, Artificial Sequence
  ORF2 (NphB) recombinant mutant F123A, S177W, G205L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFWELSAQTLEAESVLALVRELGLHVPNELLLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 88 - protein, 307 aa, Artificial Sequence
  ORF2 (NphB) recombinant mutant S177W, Y288H, V294N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDNQRGLLKAFDSLED

SEQ ID NO: 89 - protein, 307 aa, Artificial Sequence
  ORF2 (NphB) recombinant mutant A108G, Q161S, G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVSMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 90 - protein, 307 aa, Artificial Sequence
  ORF2 (NphB) recombinant mutant Y121W, S177Y, G286E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 91 - protein, 307 aa, Artificial Sequence
  ORF2 (NphB) recombinant mutant A17T, F123W, L298A
MSEAADVERVYAAMEETAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGALKAFDSLED

SEQ ID NO: 92 - protein, 307 aa, Artificial Sequence
  ORF2 (NphB) recombinant mutant N173D, F213M, V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVDLYFSELSAQTLEAESVLALVRELGLHVPNELGLKFCKRSMSVYPTLNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 93 - protein, 307 aa, Artificial Sequence
  ORF2 (NphB) recombinant mutant A53T, E112D, G205M
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGDVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 94 - protein, 307 aa, Artificial Sequence
  ORF2 (NphB) recombinant mutant Q38G, L174V, S214R
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 95 - protein, 307 aa, Artificial Sequence
  ORF2 (NphB) recombinant mutant A17T, V49A, C230N
MSEAADVERVYAAMEETAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLNFAVISNDPTLVPSSDEGDIEKFHNYATKAPYAYVGEKRTLVYGLTLSPKEEYYKLGAYYHITDVQRGLLKAFDSLED

SEQ ID NO: 96 - protein, 307 aa, Artificial Sequence
  ORF2 (NphB) recombinant mutant A17T, Q161W, A232S
MSEAADVERVYAAMEETAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 97 - protein, 307 aa, Artificial Sequence
  ORF2 (NphB) recombinant mutant Q161W, R228Q, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVWRGLLKAFDSLED

SEQ ID NO: 98 - protein, 307 aa, Artificial Sequence
  ORF2 (NphB) recombinant mutant Y288A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAAYHITDVQRGLLKAFDSLED

SEQ ID NO: 99 - protein, 307 aa, Artificial Sequence
  ORF2 (NphB) recombinant mutant Y288C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGACYHITDVQRGLLKAFDSLED

SEQ ID NO: 100 - protein, 307 aa, Artificial Sequence
  ORF2 (NphB) recombinant mutant Y288D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGADYHITDVQRGLLKAFDSLED

SEQ ID NO: 101 - protein, 307 aa, Artificial Sequence
  ORF2 (NphB) recombinant mutant Y288E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAEYHITDVQRGLLKAFDSLED

SEQ ID NO: 102 - protein, 307 aa, Artificial Sequence
  ORF2 (NphB) recombinant mutant Y288F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAFYHITDVQRGLLKAFDSLED

SEQ ID NO: 103 - protein, 307 aa, Artificial Sequence
  ORF2 (NphB) recombinant mutant Y288G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAGYHITDVQRGLLKAFDSLED

SEQ ID NO: 104 - protein, 307 aa, Artificial Sequence
  ORF2 (NphB) recombinant mutant Y288H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 105 - protein, 307 aa, Artificial Sequence
  ORF2 (NphB) recombinant mutant Y288I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAIYHITDVQRGLLKAFDSLED

SEQ ID NO: 106 - protein, 307 aa, Artificial Sequence
  ORF2 (NphB) recombinant mutant Y288K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAKYHITDVQRGLLKAFDSLED

SEQ ID NO: 107 - protein, 307 aa, Artificial Sequence
  ORF2 (NphB) recombinant mutant Y288L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGALYHITDVQRGLLKAFDSLED

SEQ ID NO: 108 - protein, 307 aa, Artificial Sequence
  ORF2 (NphB) recombinant mutant Y288M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAMYHITDVQRGLLKAFDSLED

SEQ ID NO: 109 - protein, 307 aa, Artificial Sequence
  ORF2 (NphB) recombinant mutant Y288N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGANYHITDVQRGLLKAFDSLED

SEQ ID NO: 110 - protein, 307 aa, Artificial Sequence
  ORF2 (NphB) recombinant mutant Y288P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAPYHITDVQRGLLKAFDSLED

SEQ ID NO: 111 - protein, 307 aa, Artificial Sequence
  ORF2 (NphB) recombinant mutant Y288Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAQYHITDVQRGLLKAFDSLED

SEQ ID NO: 112 - protein, 307 aa, Artificial Sequence
  ORF2 (NphB) recombinant mutant Y288R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGARYHITDVQRGLLKAFDSLED

SEQ ID NO: 113 - protein, 307 aa, Artificial Sequence
  ORF2 (NphB) recombinant mutant Y288S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGASYHITDVQRGLLKAFDSLED

SEQ ID NO: 114 - protein, 307 aa, Artificial Sequence
  ORF2 (NphB) recombinant mutant Y288T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGATYHITDVQRGLLKAFDSLED

SEQ ID NO: 115 - protein, 307 aa, Artificial Sequence
  ORF2 (NphB) recombinant mutant Y288V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAVYHITDVQRGLLKAFDSLED

SEQ ID NO: 116 - protein, 307 aa, Artificial Sequence
  ORF2 (NphB) recombinant mutant Y288W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAWYHITDVQRGLLKAFDSLED

SEQ ID NO: 117 - protein, 307 aa, Artificial Sequence [sequence omitted]

SEQ ID NO: 118 - protein, 307 aa, Artificial Sequence
  ORF2 (NphB) recombinant mutant Q161A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 119 - protein, 307 aa, Artificial Sequence
  ORF2 (NphB) recombinant mutant Q161C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVCMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 120 - protein, 307 aa, Artificial Sequence
  ORF2 (NphB) recombinant mutant Q161D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVDMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 121 - protein, 307 aa, Artificial Sequence
  ORF2 (NphB) recombinant mutant Q161E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVEMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 122 - protein, 307 aa, Artificial Sequence
  ORF2 (NphB) recombinant mutant Q161F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVFMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 123 - protein, 307 aa, Artificial Sequence
  ORF2 (NphB) recombinant mutant Q161G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVGMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 124 - protein, 307 aa, Artificial Sequence
  ORF2 (NphB) recombinant mutant Q161H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVHMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 125 - protein, 307 aa, Artificial Sequence
  ORF2 (NphB) recombinant mutant Q161I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVIMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 126 - protein, 307 aa, Artificial Sequence
  ORF2 (NphB) recombinant mutant Q161K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVKMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 127 - protein, 307 aa, Artificial Sequence
  ORF2 (NphB) recombinant mutant Q161L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVLMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 128 - protein, 307 aa, Artificial Sequence
  ORF2 (NphB) recombinant mutant Q161M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVMMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 129 - protein, 307 aa, Artificial Sequence
  ORF2 (NphB) recombinant mutant Q161N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVNMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 130 - protein, 307 aa, Artificial Sequence
  ORF2 (NphB) recombinant mutant Q161P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVPMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 131 - protein, 307 aa, Artificial Sequence [sequence omitted]

SEQ ID NO: 132 - protein, 307 aa, Artificial Sequence
  ORF2 (NphB) recombinant mutant Q161R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVRMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 133 - protein, 307 aa, Artificial Sequence
  ORF2 (NphB) recombinant mutant Q161S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 134 - protein, 307 aa, Artificial Sequence
  ORF2 (NphB) recombinant mutant Q161T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVTMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 135 - protein, 307 aa, Artificial Sequence
  ORF2 (NphB) recombinant mutant Q161V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVVMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 136 - protein, 307 aa, Artificial Sequence
  ORF2 (NphB) recombinant mutant Q161W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 137 - protein, 307 aa, Artificial Sequence
  ORF2 (NphB) recombinant mutant Q161Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVYMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 138 - protein, 307 aa, Artificial Sequence
  ORF2 (NphB) recombinant mutant Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 139 - protein, 307 aa, Artificial Sequence
  ORF2 (NphB) recombinant mutant Q295C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVCRGLLKAFDSLED

SEQ ID NO: 140 - protein, 307 aa, Artificial Sequence
  ORF2 (NphB) recombinant mutant Q295D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVDRGLLKAFDSLED

SEQ ID NO: 141 - protein, 307 aa, Artificial Sequence
  ORF2 (NphB) recombinant mutant Q295E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVERGLLKAFDSLED

SEQ ID NO: 142 - protein, 307 aa, Artificial Sequence
  ORF2 (NphB) recombinant mutant Q295F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 143 - protein, 307 aa, Artificial Sequence
  ORF2 (NphB) recombinant mutant Q295G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVGRGLLKAFDSLED

SEQ ID NO: 144 - protein, 307 aa, Artificial Sequence
  ORF2 (NphB) recombinant mutant Q295H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVHRGLLKAFDSLED

SEQ ID NO: 145 - protein, 307 aa, Artificial Sequence
  ORF2 (NphB) recombinant mutant Q295I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVIRGLLKAFDSLED

SEQ ID NO: 146 - protein, 307 aa, Artificial Sequence
  ORF2 (NphB) recombinant mutant Q295K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVKRGLLKAFDSLED

SEQ ID NO: 147 - protein, 307 aa, Artificial Sequence
  ORF2 (NphB) recombinant mutant Q295L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVLRGLLKAFDSLED

SEQ ID NO: 148 - protein, 307 aa, Artificial Sequence
  ORF2 (NphB) recombinant mutant Q295M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVMRGLLKAFDSLED

SEQ ID NO: 149 - protein, 307 aa, Artificial Sequence
  ORF2 (NphB) recombinant mutant Q295N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 150 - protein, 307 aa, Artificial Sequence
  ORF2 (NphB) recombinant mutant Q295P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVPRGLLKAFDSLED

SEQ ID NO: 151 - protein, 307 aa, Artificial Sequence [sequence omitted]

SEQ ID NO: 152 - protein, 307 aa, Artificial Sequence
  ORF2 (NphB) recombinant mutant Q295R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVRRGLLKAFDSLED

SEQ ID NO: 153 - protein, 307 aa, Artificial Sequence
  ORF2 (NphB) recombinant mutant Q295S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVSRGLLKAFDSLED

SEQ ID NO: 154 - protein, 307 aa, Artificial Sequence
  ORF2 (NphB) recombinant mutant Q295T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVTRGLLKAFDSLED

SEQ ID NO: 155 - protein, 307 aa, Artificial Sequence
  ORF2 (NphB) recombinant mutant Q295V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVVRGLLKAFDSLED

SEQ ID NO: 156 - protein, 307 aa, Artificial Sequence
  ORF2 (NphB) recombinant mutant Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 157 - protein, 307 aa, Artificial Sequence
  ORF2 (NphB) recombinant mutant Q295Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVYRGLLKAFDSLED

SEQ ID NO: 158 - protein, 307 aa, Artificial Sequence
  ORF2 (NphB) recombinant mutant S214A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFAVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 159 - protein, 307 aa, Artificial Sequence
  ORF2 (NphB) recombinant mutant S214C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFCVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 160 - protein, 307 aa, Artificial Sequence
  ORF2 (NphB) recombinant mutant S214D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFDVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 161 - protein, 307 aa, Artificial Sequence
  ORF2 (NphB) recombinant mutant S214E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFEVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 162 - protein, 307 aa, Artificial Sequence
  ORF2 (NphB) recombinant mutant S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 163 - protein, 307 aa, Artificial Sequence
  ORF2 (NphB) recombinant mutant S214G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 164 - protein, 307 aa, Artificial Sequence
  ORF2 (NphB) recombinant mutant S214H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFHVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 165 - protein, 307 aa, Artificial Sequence
  ORF2 (NphB) recombinant mutant S214I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFIVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 166 - protein, 307 aa, Artificial Sequence
  ORF2 (NphB) recombinant mutant S214K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFKVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 167 - protein, 307 aa, Artificial Sequence
  ORF2 (NphB) recombinant mutant S214L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFLVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 168 - protein, 307 aa, Artificial Sequence
  ORF2 (NphB) recombinant mutant S214M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFMVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 169 - protein, 307 aa, Artificial Sequence
  ORF2 (NphB) recombinant mutant S214N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFNVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 170 - protein, 307 aa, Artificial Sequence
  ORF2 (NphB) recombinant mutant S214P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFPVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 171 - protein, 307 aa, Artificial Sequence
  ORF2 (NphB) recombinant mutant S214Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFQVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 172 - protein, 307 aa, Artificial Sequence
  ORF2 (NphB) recombinant mutant S214R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 173 - protein, 307 aa, Artificial Sequence [sequence omitted]

SEQ ID NO: 174 - protein, 307 aa, Artificial Sequence
  ORF2 (NphB) recombinant mutant S214T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFTVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 175 - protein, 307 aa, Artificial Sequence
  ORF2 (NphB) recombinant mutant S214V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFVVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 176 - protein, 307 aa, Artificial Sequence
  ORF2 (NphB) recombinant mutant S214W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFWVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 177 - protein, 307 aa, Artificial Sequence
  ORF2 (NphB) recombinant mutant S214Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFYVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 178 - protein, 307 aa, Artificial Sequence [sequence omitted]

SEQ ID NO: 179 - protein, 307 aa, Artificial Sequence
  ORF2 (NphB) recombinant mutant A53C
MSEAADVERVYAAMEEAAGLLGVACARDKIYPLLSTFQDTLVEGGSVVVFSMCSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 180 - protein, 307 aa, Artificial Sequence
  ORF2 (NphB) recombinant mutant A53D
MSEAADVERVYAAMEEAAGLLGVACARDKIYPLLSTFQDTLVEGGSVVVFSMDSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 181 - protein, 307 aa, Artificial Sequence
  ORF2 (NphB) recombinant mutant A53E
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 182 - protein, 307 aa, Artificial Sequence
  ORF2 (NphB) recombinant mutant A53F
MSEAADVERVYAAMEEAAGLLGVACARDKIYPLLSTFQDTLVEGGSVVVFSMFSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 183 - protein, 307 aa, Artificial Sequence
  ORF2 (NphB) recombinant mutant A53G
MSEAADVERVYAAMEEAAGLLGVACARDKIYPLLSTFQDTLVEGGSVVVFSMGSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 184 - protein, 307 aa, Artificial Sequence
  ORF2 (NphB) recombinant mutant A53H
MSEAADVERVYAAMEEAAGLLGVACARDKIYPLLSTFQDTLVEGGSVVVFSMHSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 185 - protein, 307 aa, Artificial Sequence
  ORF2 (NphB) recombinant mutant A53I
MSEAADVERVYAAMEEAAGLLGVACARDKIYPLLSTFQDTLVEGGSVVVFSMISGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 186 - protein, 307 aa, Artificial Sequence
  ORF2 (NphB) recombinant mutant A53K
MSEAADVERVYAAMEEAAGLLGVACARDKIYPLLSTFQDTLVEGGSVVVFSMKSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 187 - protein, 307 aa, Artificial Sequence
  ORF2 (NphB) recombinant mutant A53L
MSEAADVERVYAAMEEAAGLLGVACARDKIYPLLSTFQDTLVEGGSVVVFSMLSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 188 - protein, 307 aa, Artificial Sequence
  ORF2 (NphB) recombinant mutant A53M
MSEAADVERVYAAMEEAAGLLGVACARDKIYPLLSTFQDTLVEGGSVVVFSMMSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 189 - protein, 307 aa, Artificial Sequence
  ORF2 (NphB) recombinant mutant A53N
MSEAADVERVYAAMEEAAGLLGVACARDKIYPLLSTFQDTLVEGGSVVVFSMNSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 190 - protein, 307 aa, Artificial Sequence
  ORF2 (NphB) recombinant mutant A53P
MSEAADVERVYAAMEEAAGLLGVACARDKIYPLLSTFQDTLVEGGSVVVFSMPSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 191 - protein, 307 aa, Artificial Sequence
  ORF2 (NphB) recombinant mutant A53Q
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 192 - protein, 307 aa, Artificial Sequence
  ORF2 (NphB) recombinant mutant A53R
MSEAADVERVYAAMEEAAGLLGVACARDKIYPLLSTFQDTLVEGGSVVVFSMRSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 193 - protein, 307 aa, Artificial Sequence
  ORF2 (NphB) recombinant mutant A53S
MSEAADVERVYAAMEEAAGLLGVACARDKIYPLLSTFQDTLVEGGSVVVFSMSSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 194 - protein, 307 aa, Artificial Sequence
  ORF2 (NphB) recombinant mutant A53T
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 195 - protein, 307 aa, Artificial Sequence
  ORF2 (NphB) recombinant mutant A53V
MSEAADVERVYAAMEEAAGLLGVACARDKIYPLLSTFQDTLVEGGSVVVFSMVSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 196 - protein, 307 aa, Artificial Sequence
  ORF2 (NphB) recombinant mutant A53W
MSEAADVERVYAAMEEAAGLLGVACARDKIYPLLSTFQDTLVEGGSVVVFSMWSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 197 - protein, 307 aa, Artificial Sequence
  ORF2 (NphB) recombinant mutant A53Y
MSEAADVERVYAAMEEAAGLLGVACARDKIYPLLSTFQDTLVEGGSVVVFSMYSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 198 - protein, 307 aa, Artificial Sequence
  ORF2 (NphB) recombinant mutant V294N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 199 - protein, 307 aa, Artificial Sequence
  ORF2 (NphB) recombinant mutant L219F, V294N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 200 - protein, 307 aa, Artificial Sequence
  ORF2 (NphB) recombinant mutant L219F, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 201 - protein, 307 aa, Artificial Sequence
  ORF2 (NphB) recombinant mutant V294N, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNARGLLKAFDSLED

SEQ ID NO: 202 - protein, 307 aa, Artificial Sequence
  ORF2 (NphB) recombinant mutant L219F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 203 - protein, 307 aa, Artificial Sequence
  ORF2 (NphB) recombinant mutant V49A
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 204 - protein, 307 aa, Artificial Sequence
  ORF2 (NphB) recombinant mutant V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 205 - protein, 307 aa, Artificial Sequence
  ORF2 (NphB) recombinant mutant V49A, V294A
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 206 - protein, 307 aa, Artificial Sequence
  ORF2 (NphB) recombinant mutant Q161S, V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 207 - protein, 307 aa, Artificial Sequence
  ORF2 (NphB) recombinant mutant V49A, Q161S
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 208 - protein, 307 aa, Artificial Sequence
  ORF2 (NphB) recombinant mutant S177Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 209 - protein, 307 aa, Artificial Sequence; identical to SEQ ID NO: 104
  ORF2 (NphB) recombinant mutant Y288H

SEQ ID NO: 210 - protein, 307 aa, Artificial Sequence
  ORF2 (NphB) recombinant mutant A53Q, Y288H
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 211 - protein, 307 aa, Artificial Sequence
  ORF2 (NphB) recombinant mutant S177Y, Y288H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 212 - protein, 307 aa, Artificial Sequence
  ORF2 (NphB) recombinant mutant A53Q, S177Y
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 213 - protein, 307 aa, Artificial Sequence
  ORF2 (NphB) recombinant mutant D166E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 214 - protein, 307 aa, Artificial Sequence
  ORF2 (NphB) recombinant mutant A53T, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 215 - protein, 307 aa, Artificial Sequence
  ORF2 (NphB) recombinant mutant D166E, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 216 - protein, 307 aa, Artificial Sequence
  ORF2 (NphB) recombinant mutant A53T D166E
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 217 - protein, 307 aa, Artificial Sequence
  ORF2 (NphB) recombinant mutant F123H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 218 - protein, 307 aa, Artificial Sequence
  ORF2 (NphB) recombinant mutant L174V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 219 - protein, 307 aa, Artificial Sequence
  ORF2 (NphB) recombinant mutant S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 220 - protein, 307 aa, Artificial Sequence
  ORF2 (NphB) recombinant mutant F123H, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 221 - protein, 307 aa, Artificial Sequence
  ORF2 (NphB) recombinant mutant L174V, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 222 - protein, 307 aa, Artificial Sequence
  ORF2 (NphB) recombinant mutant F123H, L174V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 223 - protein, 307 aa, Artificial Sequence
  ORF2 (NphB) recombinant mutant M106E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 224 - protein, 307 aa, Artificial Sequence
  ORF2 (NphB) recombinant mutant A53T, Q161S
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 225 - protein, 307 aa, Artificial Sequence
  ORF2 (NphB) recombinant mutant M106E, Q161S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 226 - protein, 307 aa, Artificial Sequence
  ORF2 (NphB) recombinant mutant A53T, M106E
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 227 - protein, 307 aa, Artificial Sequence
  ORF2 (NphB) recombinant mutant Q38G
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 228 - protein, 307 aa, Artificial Sequence; identical to SEQ ID NO: 213
  ORF2 (NphB) recombinant mutant D166E

SEQ ID NO: 229 - protein, 307 aa, Artificial Sequence; identical to SEQ ID NO: 138
  ORF2 (NphB) recombinant mutant Q295A

SEQ ID NO: 230 - protein, 307 aa, Artificial Sequence
  ORF2 (NphB) recombinant mutant Q38G, Q295A
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 231 - protein, 307 aa, Artificial Sequence
  ORF2 (NphB) recombinant mutant D166E, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 232 - protein, 307 aa, Artificial Sequence
  ORF2 (NphB) recombinant mutant Q38G, D166E
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 233 - protein, 307 aa, Artificial Sequence
  ORF2 (NphB) recombinant mutant K118N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 234 - protein, 307 aa, Artificial Sequence; identical to SEQ ID NO: 162
  ORF2 (NphB) recombinant mutant S214F

SEQ ID NO: 235 - protein, 307 aa, Artificial Sequence
  ORF2 (NphB) recombinant mutant A53T, S214F
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 236 - protein, 307 aa, Artificial Sequence
  ORF2 (NphB) recombinant mutant K118N, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 237 - protein, 307 aa, Artificial Sequence
  ORF2 (NphB) recombinant mutant A53T, K118N
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 238 - protein, 307 aa, Artificial Sequence
  ORF2 (NphB) recombinant mutant S177W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 239 - protein, 307 aa, Artificial Sequence; identical to SEQ ID NO: 202
  ORF2 (NphB) recombinant mutant L219F

SEQ ID NO: 240 - protein, 307 aa, Artificial Sequence
  ORF2 (NphB) recombinant mutant S177W, L219F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 241 - protein, 307 aa, Artificial Sequence
  ORF2 (NphB) recombinant mutant A53Q, S177W
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 242 - protein, 307 aa, Artificial Sequence
  ORF2 (NphB) recombinant mutant A53Q, L219F
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 243 - protein, 307 aa, Artificial Sequence
  ORF2 (NphB) recombinant mutant A108G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 244 - protein, 307 aa, Artificial Sequence
  ORF2 (NphB) recombinant mutant G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 245 - protein, 307 aa, Artificial Sequence
  ORF2 (NphB) recombinant mutant A108G, G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 246 - protein, 307 aa, Artificial Sequence
  ORF2 (NphB) recombinant mutant Q161S, G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 247 - protein, 307 aa, Artificial Sequence
  ORF2 (NphB) recombinant mutant A108G, Q161S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 248 - protein, 307 aa, Artificial Sequence
  ORF2 (NphB) recombinant mutant K118Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 249 - protein, 307 aa, Artificial Sequence
  ORF2 (NphB) recombinant mutant M162A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 250 - protein, 307 aa, Artificial Sequence
  ORF2 (NphB) recombinant mutant Y283L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 251 - protein, 307 aa, Artificial Sequence
  ORF2 (NphB) recombinant mutant V271E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLEYGLTLSPKEEYYKLGAYYHITDVQRGLLKAFDSLED

SEQ ID NO: 252 - protein, 307 aa, Artificial Sequence
  ORF2 (NphB) recombinant mutant K119D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 253 - protein, 307 aa, Artificial Sequence
  ORF2 (NphB) recombinant mutant L274V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVQRGLLKAFDSLED

SEQ ID NO: 254 - protein, 307 aa, Artificial Sequence
  ORF2 (NphB) recombinant mutant A232S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 255 - protein, 307 aa, Artificial Sequence; identical to SEQ ID NO: 118
  ORF2 (NphB) recombinant mutant Q161A

SEQ ID NO: 256 - protein, 307 aa, Artificial Sequence
  ORF2 (NphB) recombinant mutant G205L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 257 - protein, 307 aa, Artificial Sequence; identical to SEQ ID NO: 163
  ORF2 (NphB) recombinant mutant S214G

SEQ ID NO: 258 - protein, 307 aa, Artificial Sequence
  ORF2 (NphB) recombinant mutant Y216A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVAPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 259 - protein, 307 aa, Artificial Sequence
  ORF2 (NphB) recombinant mutant N173D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVDLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 260 - protein, 307 aa, Artificial Sequence
  ORF2 (NphB) recombinant mutant F123W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 261 - protein, 307 aa, Artificial Sequence; identical to SEQ ID NO: 233
  ORF2 (NphB) recombinant mutant K118N

SEQ ID NO: 262 - protein, 307 aa, Artificial Sequence
  ORF2 (NphB) recombinant mutant R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 263 - protein, 307 aa, Artificial Sequence; identical to SEQ ID NO: 136
  ORF2 (NphB) recombinant mutant Q161W

SEQ ID NO: 264 - protein, 307 aa, Artificial Sequence
  ORF2 (NphB) recombinant mutant V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 265 - protein, 307 aa, Artificial Sequence; identical to SEQ ID NO: 172
  ORF2 (NphB) recombinant mutant S214R

SEQ ID NO: 266 - protein, 307 aa, Artificial Sequence
  ORF2 (NphB) recombinant mutant G286E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 267 - protein, 307 aa, Artificial Sequence
  ORF2 (NphB) recombinant mutant R228E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 268 - protein, 307 aa, Artificial Sequence
  ORF2 (NphB) recombinant mutant C230S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLSFAVISNDPTLVPSSDEGDIEKFHNYATKAPYAYVGEKRTLVYGLTLSPKEEYYKLGAYYHITDVQRGLLKAFDSLED

SEQ ID NO: 269 - protein, 307 aa, Artificial Sequence
  ORF2 (NphB) recombinant mutant D227E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIERLCFAVISNDPTLVPSSDEGDIEKFHNYATKAPYAYVGEKRTLVYGLTLSPKEEYYKLGAYYHITDVQRGLLKAFDSLED

SEQ ID NO: 270 - protein, 307 aa, Artificial Sequence
  ORF2 (NphB) recombinant mutant M162F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 271 - protein, 307 aa, Artificial Sequence
  ORF2 (NphB) recombinant mutant F123A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 272 - protein, 307 aa, Artificial Sequence
  ORF2 (NphB) recombinant mutant A53T, V294A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 273 - protein, 307 aa, Artificial Sequence
  ORF2 (NphB) recombinant mutant A53T, Q161S, V294A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 274 - protein, 307 aa, Artificial Sequence
  ORF2 (NphB) recombinant mutant A53T, Q161S, V294N
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 275 - protein, 307 aa, Artificial Sequence
  ORF2 (NphB) recombinant mutant A53T, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 276 - protein, 307 aa, Artificial Sequence
  ORF2 (NphB) recombinant mutant Q161S, V294A, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAARGLLKAFDSLED

SEQ ID NO: 277 - protein, 307 aa, Artificial Sequence
  ORF2 (NphB) recombinant mutant A53T, Q161S, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 278 - protein, 307 aa, Artificial Sequence
  ORF2 (NphB) recombinant mutant A53T, V294A, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAARGLLKAFDSLED

SEQ ID NO: 279 - protein, 307 aa, Artificial Sequence
  ORF2 (NphB) recombinant mutant A53T, Q161S, V294A, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAARGLLKAFDSLED

SEQ ID NO: 280 - protein, 307 aa, Artificial Sequence
  ORF2 (NphB) recombinant mutant A53T, Q161S, V294N, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNARGLLKAFDSLED

SEQ ID NO: 281 - protein, 307 aa, Artificial Sequence; identical to SEQ ID NO: 214
  ORF2 (NphB) recombinant mutant A53T, Q295W

SEQ ID NO: 282 - protein, 307 aa, Artificial Sequence
  ORF2 (NphB) recombinant mutant Q161S, V294A, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAWRGLLKAFDSLED

SEQ ID NO: 283 - protein, 307 aa, Artificial Sequence
  ORF2 (NphB) recombinant mutant A53T, Q161S, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 284 - protein, 307 aa, Artificial Sequence
  ORF2 (NphB) recombinant mutant A53T, V294A, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAWRGLLKAFDSLED

SEQ ID NO: 285 - protein, 307 aa, Artificial Sequence
  ORF2 (NphB) recombinant mutant A53T, Q161S, V294A, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAWRGLLKAFDSLED

SEQ ID NO: 286 - protein, 307 aa, Artificial Sequence
  ORF2 (NphB) recombinant mutant A53T, Q161S, V294N, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNWRGLLKAFDSLED

SEQ ID NO: 287 - protein, 307 aa, Artificial Sequence
  ORF2 (NphB) recombinant mutant S177W, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 288 - protein, 307 aa, Artificial Sequence
  ORF2 (NphB) recombinant mutant S177W, S214R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 289 - protein, 307 aa, Artificial Sequence
  ORF2 (NphB) recombinant mutant Q161S, S177W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 290 - protein, 307 aa, Artificial Sequence
  ORF2 (NphB) recombinant mutant A53T, S177W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 291 - protein, 307 aa, Artificial Sequence
  ORF2 (NphB) recombinant mutant V49A, Q295L
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVLRGLLKAFDSLED

SEQ ID NO: 292 - protein, 307 aa, Artificial Sequence
  ORF2 (NphB) recombinant mutant V49A, S214R
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 293 - protein, 307 aa, Artificial Sequence
  ORF2 (NphB) recombinant mutant A53T, Q295F
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 294 - protein, 307 aa, Artificial Sequence
  ORF2 (NphB) recombinant mutant A53T, S214R
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 295 - protein, 307 aa, Artificial Sequence; identical to SEQ ID NO: 224
  ORF2 (NphB) recombinant mutant A53T, Q161S

SEQ ID NO: 296 - protein, 307 aa, Artificial Sequence
  ORF2 (NphB) recombinant mutant Q161S, Q295F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 297 - protein, 307 aa, Artificial Sequence
  ORF2 (NphB) recombinant mutant Q161S, Q295L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVLRGLLKAFDSLED

SEQ ID NO: 298 - protein, 307 aa, Artificial Sequence
  ORF2 (NphB) recombinant mutant Q161S, S214R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 299 - protein, 307 aa, Artificial Sequence
  ORF2 (NphB) recombinant mutant S214R, Q295F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 300 - protein, 307 aa, Artificial Sequence; identical to SEQ ID NO: 207
  ORF2 (NphB) recombinant mutant V49A, Q161S

SEQ ID NO: 301 - DNA, 927 bp, Unknown
  Streptomyces sp. strain CL190
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 302 - DNA, 927 bp, Artificial Sequence
  ORF2 (NphB) recombinant mutant A108G, Q295N, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggccagctgaaagcgtttgactctttggaagattaatga

SEQ ID NO: 303 - DNA, 927 bp, Artificial Sequence
  ORF2 (NphB) recombinant mutant K119A, Q161S, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 304 - DNA, 927 bp, Artificial Sequence
  ORF2 (NphB) recombinant mutant V49S, M162A, Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 305 - DNA, 927 bp, Artificial Sequence
  ORF2 (NphB) recombinant mutant K118Q, Q161W, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 306 - DNA, 927 bp, Artificial Sequence
  ORF2 (NphB) recombinant mutant Q161A, S214G, V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 307 - DNA, 927 bp, Artificial Sequence
  ORF2 (NphB) recombinant mutant F123W, S177W, G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 308 - DNA, 927 bp, Artificial Sequence
  ORF2 (NphB) recombinant mutant K118N, N173D, Q295N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggcctgctgaaagcgtttgactctttggaagattaatga

SEQ ID NO: 309 - DNA, 927 bp, Artificial Sequence
  ORF2 (NphB) recombinant mutant K119A, Q161A, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 310 - DNA, 927 bp, Artificial Sequence
  ORF2 (NphB) recombinant mutant Q38G, E112D, F123H
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 311 - DNA, 927 bp, Artificial Sequence
  ORF2 (NphB) recombinant mutant V49A, S177Y, C209G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 312 - DNA, 927 bp, Artificial Sequence
  ORF2 (NphB) recombinant mutant K118N, K119A, V271E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacgcgacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 313 - DNA, 927 bp, Artificial Sequence
  ORF2 (NphB) recombinant mutant L174V, C230N, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggccagctgaaagcgtttgactctttggaagattaatga

SEQ ID NO: 314 - DNA, 927 bp, Artificial Sequence
  ORF2 (NphB) recombinant mutant K119D, S177E, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 315 - DNA, 927 bp, Artificial Sequence
  ORF2 (NphB) recombinant mutant A53E, E112G, R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 316 - DNA, 927 bp, Artificial Sequence
  ORF2 (NphB) recombinant mutant A53E, F213M, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 317 - DNA, 927 bp, Artificial Sequence
  ORF2 (NphB) recombinant mutant A53Q, S177W, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 318 - DNA, 927 bp, Artificial Sequence
  ORF2 (NphB) recombinant mutant F123A, Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 319 - DNA, 927 bp, Artificial Sequence
  ORF2 (NphB) recombinant mutant C25V, Y121W, M162F
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 320 - DNA, 927 bp, Artificial Sequence
  ORF2 (NphB) recombinant mutant V49L, S214R, V271E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 321 - DNA, 927 bp, Artificial Sequence
  ORF2 (NphB) recombinant mutant D227E, C230N, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 322 - DNA, 927 bp, Artificial Sequence
  ORF2 (NphB) recombinant mutant G205L, Y216A, C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgttgcgccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 323 - DNA, 927 bp, Artificial Sequence
  ORF2 (NphB) recombinant mutant Q161S, V294F, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggctggctgaaagcgtttgactctttggaagattaatga

SEQ ID NO: 324 - DNA, 927 bp, Artificial Sequence
  ORF2 (NphB) recombinant mutant L219F, Y283L, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggctggctgaaagcgtttgactctttggaagattaatga

SEQ ID NO: 325 - DNA, 927 bp, Artificial Sequence
  ORF2 (NphB) recombinant mutant A17T, F213M, S214R
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 326 - DNA, 927 bp, Artificial Sequence
  ORF2 (NphB) recombinant mutant L219F, V294N, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaacgcgcgtggcctgctgaaagcgtttgactctttggaagattaatga

SEQ ID NO: 327 - DNA, 927 bp, Artificial Sequence
  ORF2 (NphB) recombinant mutant A53E, A108G, K118N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 328 - DNA, 927 bp, Artificial Sequence
  ORF2 (NphB) recombinant mutant Q38G, E112G, M162F
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 329 - DNA, 927 bp, Artificial Sequence
  ORF2 (NphB) recombinant mutant A53T, D166E, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 330 - DNA, 927 bp, Artificial Sequence
  ORF2 (NphB) recombinant mutant L174V, C230S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 331 - DNA, 927 bp, Artificial Sequence
  ORF2 (NphB) recombinant mutant M106E, G286E, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggctggctgaaagcgtttgactctttggaagattaatga

SEQ ID NO: 332 - DNA, 927 bp, Artificial Sequence
  ORF2 (NphB) recombinant mutant D227E, R228E, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaggagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggccagctgaaagcgtttgactctttggaagattaatga

SEQ ID NO: 333 - DNA, 927 bp, Artificial Sequence
  ORF2 (NphB) recombinant mutant M162A, C209G, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 334 - DNA, 927 bp, Artificial Sequence
  ORF2 (NphB) recombinant mutant A17T, C25V, E112G
atgagcgaagcggcggacgtcgaacgtgtttatgcagcgatggaagaaaccgccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 335 - DNA, 927 bp, Artificial Sequence
  ORF2 (NphB) recombinant mutant A53Q, Y121W, A232S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 336 - DNA, 927 bp, Artificial Sequence
  ORF2 (NphB) recombinant mutant A53Q, S177Y, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 337 - DNA, 927 bp, Artificial Sequence
  ORF2 (NphB) recombinant mutant F123H, L274V, L298A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcgcgctgaaagcgtttgactctttggaagattaatga

SEQ ID NO: 338 - DNA, 927 bp, Artificial Sequence
  ORF2 (NphB) recombinant mutant S177W, S214F, Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 339 - DNA, 927 bp, Artificial Sequence
  ORF2 (NphB) recombinant mutant A53E, G205M, L274V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcctgctgaaagcgtttgactctttggaagattaatga

SEQ ID NO: 340 - DNA, 927 bp, Artificial Sequence
  ORF2 (NphB) recombinant mutant A53T, K118N, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 341 - DNA, 927 bp, Artificial Sequence
  ORF2 (NphB) recombinant mutant S177E, S214R, R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 342 - DNA, 927 bp, Artificial Sequence
  ORF2 (NphB) recombinant mutant K118Q, S177Y, D227E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 343 - DNA, 927 bp, Artificial Sequence
  ORF2 (NphB) recombinant mutant D166E, S177Y, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 344 - DNA, 927 bp, Artificial Sequence
  ORF2 (NphB) recombinant mutant Q161A, M162F, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 345 - DNA, 927 bp, Artificial Sequence
  ORF2 (NphB) recombinant mutant A53E, Q161A, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 346 - DNA, 927 bp, Artificial Sequence
  ORF2 (NphB) recombinant mutant A108G, F123W, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 347 - DNA, 927 bp, Artificial Sequence
  ORF2 (NphB) recombinant mutant A53Q, G205L, Q295N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggcctgctgaaagcgtttgactctttggaagattaatga

SEQ ID NO: 348 - DNA, 927 bp, Artificial Sequence
  ORF2 (NphB) recombinant mutant K118Q, F123A, R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 349 - DNA, 927 bp, Artificial Sequence
  ORF2 (NphB) recombinant mutant V49L, E112D, G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 350 - DNA, 927 bp, Artificial Sequence
  ORF2 (NphB) recombinant mutant G205L, R228E, C230N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgacgagctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 351 - DNA, 927 bp, Artificial Sequence
  ORF2 (NphB) recombinant mutant M162A, D227E, C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 352 - DNA, 927 bp, Artificial Sequence
  ORF2 (NphB) recombinant mutant V49L, K119D, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 353 - DNA, 927 bp, Artificial Sequence
  ORF2 (NphB) recombinant mutant K119A, S214G, L298A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcgcgctgaaagcgtttgactctttggaagattaatga

SEQ ID NO: 354 - DNA, 927 bp, Artificial Sequence
  ORF2 (NphB) recombinant mutant Q38G, Y216A, A232S
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 355 - DNA, 927 bp, Artificial Sequence
  ORF2 (NphB) recombinant mutant Q161A, V271E, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgtttggcgtggcctgctgaaagcgtttgactctttggaagattaatga

SEQ ID NO: 356 - DNA, 927 bp, Artificial Sequence
  ORF2 (NphB) recombinant mutant V49S, Y216A, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 357 - DNA, 927 bp, Artificial Sequence
  ORF2 (NphB) recombinant mutant F123A, M162F, S214G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 358 - DNA, 927 bp, Artificial Sequence
  ORF2 (NphB) recombinant mutant C25V, A232S, V271E
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 359 - DNA, 927 bp, Artificial Sequence
  ORF2 (NphB) recombinant mutant K118Q, L174V, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 360 - DNA, 927 bp, Artificial Sequence
  ORF2 (NphB) recombinant mutant V49S, S214G, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 361 - DNA, 927 bp, Artificial Sequence
  ORF2 (NphB) recombinant mutant E112D, K119A, N173D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 362 - DNA, 927 bp, Artificial Sequence
  ORF2 (NphB) recombinant mutant F123W, Q161W, D227E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 363 - DNA, 927 bp, Artificial Sequence
  ORF2 (NphB) recombinant mutant A53T, N173D, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 364 - DNA, 927 bp, Artificial Sequence
  ORF2 (NphB) recombinant mutant F123W, M162F, C209G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 365 - DNA, 927 bp, Artificial Sequence
  ORF2 (NphB) recombinant mutant M106E, M162A, Y216A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 366 - DNA, 927 bp, Artificial Sequence
  ORF2 (NphB) recombinant mutant V49A, Q161S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 367 - DNA, 927 bp, Artificial Sequence
  ORF2 (NphB) recombinant mutant C25V, F213M, Y216A
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 368 - DNA, 927 bp, Artificial Sequence
  ORF2 (NphB) recombinant mutant A108G, K119D, L298A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcgcgctgaaagcgtttgactctttggaagattaatga

SEQ ID NO: 369 - DNA, 927 bp, Artificial Sequence
  ORF2 (NphB) recombinant mutant K118N, C209G, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 370 - DNA, 927 bp, Artificial Sequence
  ORF2 (NphB) recombinant mutant A53T, M106E, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 371 - DNA, 927 bp, Artificial Sequence
  ORF2 (NphB) recombinant mutant Q38G, D166E, Q295A
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 372 - DNA, 927 bp, Artificial Sequence
  ORF2 (NphB) recombinant mutant M106E, G205L, C209G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 373 - DNA, 927 bp, Artificial Sequence
  ORF2 (NphB) recombinant mutant E112G, G205M, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggctggctgaaagcgtttgactctttggaagattaatga

SEQ ID NO: 374 - DNA, 927 bp, Artificial Sequence
  ORF2 (NphB) recombinant mutant V49S, K118Q, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 375 - DNA, 927 bp, Artificial Sequence
  ORF2 (NphB) recombinant mutant M106E, Y121W, D166E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 376 - DNA, 927 bp, Artificial Sequence
  ORF2 (NphB) recombinant mutant A53Q, L274V, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttgcgcgtggcctgctgaaagcgtttgactctttggaagattaatga

SEQ ID NO: 377 - DNA, 927 bp, Artificial Sequence
  ORF2 (NphB) recombinant mutant V49A, F123A, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 378 - DNA, 927 bp, Artificial Sequence
  ORF2 (NphB) recombinant mutant C25V, F123H, Q295N
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggcctgctgaaagcgtttgactctttggaagattaatga

SEQ ID NO: 379 - DNA, 927 bp, Artificial Sequence
  ORF2 (NphB) recombinant mutant K119D, Q161W, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggccagctgaaagcgtttgactctttggaagattaatga

SEQ ID NO: 380 - DNA, 927 bp, Artificial Sequence
  ORF2 (NphB) recombinant mutant V49A, Y121W, C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 381 - DNA, 927 bp, Artificial Sequence
  ORF2 (NphB) recombinant mutant M162A, N173D, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 382 - DNA, 927 bp, Artificial Sequence
  ORF2 (NphB) recombinant mutant V49L, D166E, L274V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcctgctgaaagcgtttgactctttggaagattaatga

SEQ ID NO: 383 - DNA, 927 bp, Artificial Sequence
  ORF2 (NphB) recombinant mutant V49S, K119D, F213M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 384 - DNA, 927 bp, Artificial Sequence
  ORF2 (NphB) recombinant mutant E112D, L219F, V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 385 - DNA, 927 bp, Artificial Sequence
  ORF2 (NphB) recombinant mutant F123H, L174V, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 386 - DNA, 927 bp, Artificial Sequence
  ORF2 (NphB) recombinant mutant E112G, F123H, S214G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 387 - DNA, 927 bp, Artificial Sequence
  ORF2 (NphB) recombinant mutant F123A, S177W, G205L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 388 - DNA, 927 bp, Artificial Sequence
  ORF2 (NphB) recombinant mutant S177W, Y288H, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacaaccaacgtggcctgctgaaagcgtttgactctttggaagattaatga

SEQ ID NO: 389 - DNA, 927 bp, Artificial Sequence
  ORF2 (NphB) recombinant mutant A108G, Q161S, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 390 - DNA, 927 bp, Artificial Sequence
  ORF2 (NphB) recombinant mutant Y121W, S177Y, G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 391 - DNA, 927 bp, Artificial Sequence
  ORF2 (NphB) recombinant mutant A17T, F123W, L298A
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcgcgctgaaagcgtttgactctttggaagattaatga

SEQ ID NO: 392 - DNA, 927 bp, Artificial Sequence
  ORF2 (NphB) recombinant mutant N173D, F213M, V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagcatgagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 393 - DNA, 927 bp, Artificial Sequence
  ORF2 (NphB) recombinant mutant A53T, E112D, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 394 - DNA, 927 bp, Artificial Sequence
  ORF2 (NphB) recombinant mutant Q38G, L174V, S214R
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 395 - DNA, 927 bp, Artificial Sequence
  ORF2 (NphB) recombinant mutant A17T, V49A, C230N
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 396 - DNA, 927 bp, Artificial Sequence
  ORF2 (NphB) recombinant mutant A17T, Q161W, A232S
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 397 - DNA, 927 bp, Artificial Sequence
  ORF2 (NphB) recombinant mutant Q161W, R228Q, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 398 - DNA, 927 bp, Artificial Sequence
  ORF2 (NphB) recombinant mutant Y288A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggcataccacattaccgacgttcaacgtggcctgctgaaagcgtttgactctttggaagattaatga

SEQ ID NO: 399 - DNA, 927 bp, Artificial Sequence
  ORF2 (NphB) recombinant mutant Y288C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtgttaccacattaccgacgttcaacgtggcctgctgaaagcgtttgactctttggaagattaatga

SEQ ID NO: 400 - DNA, 927 bp, Artificial Sequence
  ORF2 (NphB) recombinant mutant Y288D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggattaccacattaccgacgttcaacgtggcctgctgaaagcgtttgactctttggaagattaatga

SEQ ID NO: 401 - DNA, 927 bp, Artificial Sequence
  ORF2 (NphB) recombinant mutant Y288E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggaataccacattaccgacgttcaacgtggcctgctgaaagcgtttgactctttggaagattaatga

SEQ ID NO: 402 - DNA, 927 bp, Artificial Sequence
  ORF2 (NphB) recombinant mutant Y288F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgttttaccacattaccgacgttcaacgtggcctgctgaaagcgtttgactctttggaagattaatga

SEQ ID NO: 403 - DNA, 927 bp, Artificial Sequence
  ORF2 (NphB) recombinant mutant Y288G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgggttaccacattaccgacgttcaacgtggcctgctgaaagcgtttgactctttggaagattaatga

SEQ ID NO: 404 - DNA, 927 bp, Artificial Sequence
  ORF2 (NphB) recombinant mutant Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcattaccacattaccgacgttcaacgtggcctgctgaaagcgtttgactctttggaagattaatga

SEQ ID NO: 405 - DNA, 927 bp, Artificial Sequence
  ORF2 (NphB) recombinant mutant Y288I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgatttaccacattaccgacgttcaacgtggcctgctgaaagcgtttgactctttggaagattaatga

SEQ ID NO: 406 - DNA, 927 bp, Artificial Sequence
  ORF2 (NphB) recombinant mutant Y288K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgaaataccacattaccgacgttcaacgtggcctgctgaaagcgtttgactctttggaagattaatga

SEQ ID NO: 407 - DNA, 927 bp, Artificial Sequence
  ORF2 (NphB) recombinant mutant Y288L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgctgtaccacattaccgacgttcaacgtggcctgctgaaagcgtttgactctttggaagattaatga

SEQ ID NO: 408 - DNA, 927 bp, Artificial Sequence
  ORF2 (NphB) recombinant mutant Y288M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgatgtaccacattaccgacgttcaacgtggcctgctgaaagcgtttgactctttggaagattaatga

SEQ ID NO: 409 - DNA, 927 bp, Artificial Sequence
  ORF2 (NphB) recombinant mutant Y288N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgaattaccacattaccgacgttcaacgtggcctgctgaaagcgtttgactctttggaagattaatga

SEQ ID NO: 410 - DNA, 927 bp, Artificial Sequence
  ORF2 (NphB) recombinant mutant Y288P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgccgtaccacattaccgacgttcaacgtggcctgctgaaagcgtttgactctttggaagattaatga

SEQ ID NO: 411 - DNA, 927 bp, Artificial Sequence
  ORF2 (NphB) recombinant mutant Y288Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcagtaccacattaccgacgttcaacgtggcctgctgaaagcgtttgactctttggaagattaatga

SEQ ID NO: 412 - DNA, 927 bp, Artificial Sequence
  ORF2 (NphB) recombinant mutant Y288R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcgttaccacattaccgacgttcaacgtggcctgctgaaagcgtttgactctttggaagattaatga

SEQ ID NO: 413 - DNA, 927 bp, Artificial Sequence
  ORF2 (NphB) recombinant mutant Y288S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgagctaccacattaccgacgttcaacgtggcctgctgaaagcgtttgactctttggaagattaatga

SEQ ID NO: 414 - DNA, 927 bp, Artificial Sequence
  ORF2 (NphB) recombinant mutant Y288T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgacctaccacattaccgacgttcaacgtggcctgctgaaagcgtttgactctttggaagattaatga

SEQ ID NO: 415 - DNA, 927 bp, Artificial Sequence
  ORF2 (NphB) recombinant mutant Y288V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggtttaccacattaccgacgttcaacgtggcctgctgaaagcgtttgactctttggaagattaatga

SEQ ID NO: 416 - DNA, 927 bp, Artificial Sequence
  ORF2 (NphB) recombinant mutant Y288W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtggtaccacattaccgacgttcaacgtggcctgctgaaagcgtttgactctttggaagattaatga

SEQ ID NO: 417 - DNA, 927 bp, Artificial Sequence
  ORF2 (NphB) recombinant mutant Y288Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtattaccacattaccgacgttcaacgtggcctgctgaaagcgtttgactctttggaagattaatga

SEQ ID NO: 418 - DNA, 927 bp, Artificial Sequence
  ORF2 (NphB) recombinant mutant Q161A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcaatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 419 - DNA, 927 bp, Artificial Sequence
  ORF2 (NphB) recombinant mutant Q161C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtgtatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 420 - DNA, 927 bp, Artificial Sequence
  ORF2 (NphB) recombinant mutant Q161D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 421 - DNA, 927 bp, Artificial Sequence
  ORF2 (NphB) recombinant mutant Q161E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggaaatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 422 - DNA, 927 bp, Artificial Sequence
  ORF2 (NphB) recombinant mutant Q161F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtttatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 423 - DNA, 927 bp, Artificial Sequence
  ORF2 (NphB) recombinant mutant Q161G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgggtatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 424 - DNA, 927 bp, Artificial Sequence
  ORF2 (NphB) recombinant mutant Q161H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 425 - DNA, 927 bp, Artificial Sequence
  ORF2 (NphB) recombinant mutant Q161I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgattatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 426 - DNA, 927 bp, Artificial Sequence
  ORF2 (NphB) recombinant mutant Q161K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgaaaatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 427 - DNA, 927 bp, Artificial Sequence
  ORF2 (NphB) recombinant mutant Q161L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgctgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 428 - DNA, 927 bp, Artificial Sequence
  ORF2 (NphB) recombinant mutant Q161M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgatgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 429 - DNA, 927 bp, Artificial Sequence
  ORF2 (NphB) recombinant mutant Q161N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgaatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 430 - DNA, 927 bp, Artificial Sequence
  ORF2 (NphB) recombinant mutant Q161P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgccgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 431 - DNA, 927 bp, Artificial Sequence; identical to SEQ ID NO: 301
  ORF2 (NphB) recombinant mutant Q161Q

SEQ ID NO: 432 - DNA, 927 bp, Artificial Sequence
  ORF2 (NphB) recombinant mutant Q161R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcgtatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 433 - DNA, 927 bp, Artificial Sequence
  ORF2 (NphB) recombinant mutant Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 434 - DNA, 927 bp, Artificial Sequence
  ORF2 (NphB) recombinant mutant Q161T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgaccatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 435 - DNA, 927 bp, Artificial Sequence
  ORF2 (NphB) recombinant mutant Q161V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggttatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 436 - DNA, 927 bp, Artificial Sequence
  ORF2 (NphB) recombinant mutant Q161W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 437 - DNA, 927 bp, Artificial Sequence
  ORF2 (NphB) recombinant mutant Q161Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 438 - DNA, 927 bp, Artificial Sequence
  ORF2 (NphB) recombinant mutant Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 439 - DNA, 927 bp, Artificial Sequence
  ORF2 (NphB) recombinant mutant Q295C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttgtcgtggcctgctgaaagcgtttgactctttggaagattaatga

SEQ ID NO: 440 - DNA, 927 bp, Artificial Sequence
  ORF2 (NphB) recombinant mutant Q295D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgatcgtggcctgctgaaagcgtttgactctttggaagattaatga

SEQ ID NO: 441 - DNA, 927 bp, Artificial Sequence
  ORF2 (NphB) recombinant mutant Q295E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgaacgtggcctgctgaaagcgtttgactctttggaagattaatga

SEQ ID NO: 442 - DNA, 927 bp, Artificial Sequence
  ORF2 (NphB) recombinant mutant Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 443 - DNA, 927 bp, Artificial Sequence
  ORF2 (NphB) recombinant mutant Q295G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttggtcgtggcctgctgaaagcgtttgactctttggaagattaatga

SEQ ID NO: 444 - DNA, 927 bp, Artificial Sequence
  ORF2 (NphB) recombinant mutant Q295H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcatcgtggcctgctgaaagcgtttgactctttggaagattaatga

SEQ ID NO: 445 - DNA, 927 bp, Artificial Sequence
  ORF2 (NphB) recombinant mutant Q295I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttattcgtggcctgctgaaagcgtttgactctttggaagattaatga

SEQ ID NO: 446 - DNA, 927 bp, Artificial Sequence
  ORF2 (NphB) recombinant mutant Q295K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaacgtggcctgctgaaagcgtttgactctttggaagattaatga

SEQ ID NO: 447 - DNA, 927 bp, Artificial Sequence
  ORF2 (NphB) recombinant mutant Q295L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttctgcgtggcctgctgaaagcgtttgactctttggaagattaatga

SEQ ID NO: 448 - DNA, 927 bp, Artificial Sequence
  ORF2 (NphB) recombinant mutant Q295M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttatgcgtggcctgctgaaagcgtttgactctttggaagattaatga

SEQ ID NO: 449 - DNA, 927 bp, Artificial Sequence
  ORF2 (NphB) recombinant mutant Q295N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaatcgtggcctgctgaaagcgtttgactctttggaagattaatga

SEQ ID NO: 450 - DNA, 927 bp, Artificial Sequence
  ORF2 (NphB) recombinant mutant Q295P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttccgcgtggcctgctgaaagcgtttgactctttggaagattaatga

SEQ ID NO: 451 - DNA, 927 bp, Artificial Sequence
  ORF2 (NphB) recombinant mutant Q295Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcagcgtggcctgctgaaagcgtttgactctttggaagattaatga

SEQ ID NO: 452 - DNA, 927 bp, Artificial Sequence
  ORF2 (NphB) recombinant mutant Q295R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcgtcgtggcctgctgaaagcgtttgactctttggaagattaatga

SEQ ID NO: 453 - DNA, 927 bp, Artificial Sequence
  ORF2 (NphB) recombinant mutant Q295S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttagccgtggcctgctgaaagcgtttgactctttggaagattaatga

SEQ ID NO: 454 - DNA, 927 bp, Artificial Sequence
  ORF2 (NphB) recombinant mutant Q295T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttacccgtggcctgctgaaagcgtttgactctttggaagattaatga

SEQ ID NO: 455 - DNA, 927 bp, Artificial Sequence
  ORF2 (NphB) recombinant mutant Q295V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgttcgtggcctgctgaaagcgtttgactctttggaagattaatga

SEQ ID NO: 456 - DNA, 927 bp, Artificial Sequence
  ORF2 (NphB) recombinant mutant Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 457 - DNA, 927 bp, Artificial Sequence
  ORF2 (NphB) recombinant mutant Q295Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttatcgtggcctgctgaaagcgtttgactctttggaagattaatga

SEQ ID NO: 458 - DNA, 927 bp, Artificial Sequence
  ORF2 (NphB) recombinant mutant S214A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgcagtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 459 - DNA, 927 bp, Artificial Sequence
  ORF2 (NphB) recombinant mutant S214C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 460 - DNA, 927 bp, Artificial Sequence
  ORF2 (NphB) recombinant mutant S214D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 461 - DNA, 927 bp, Artificial Sequence
  ORF2 (NphB) recombinant mutant S214E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgaagtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 462 - DNA, 927 bp, Artificial Sequence
  ORF2 (NphB) recombinant mutant S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttttgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 463 - DNA, 927 bp, Artificial Sequence
  ORF2 (NphB) recombinant mutant S214G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 464 - DNA, 927 bp, Artificial Sequence
  ORF2 (NphB) recombinant mutant S214H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 465 - DNA, 927 bp, Artificial Sequence
  ORF2 (NphB) recombinant mutant S214I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttattgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 466 - DNA, 927 bp, Artificial Sequence
  ORF2 (NphB) recombinant mutant S214K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttaaagtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 467 - DNA, 927 bp, Artificial Sequence
  ORF2 (NphB) recombinant mutant S214L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttctggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 468 - DNA, 927 bp, Artificial Sequence
  ORF2 (NphB) recombinant mutant S214M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttatggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 469 - DNA, 927 bp, Artificial Sequence
  ORF2 (NphB) recombinant mutant S214N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttaatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 470 - DNA, 927 bp, Artificial Sequence
  ORF2 (NphB) recombinant mutant S214P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttccggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 471 - DNA, 927 bp, Artificial Sequence
  ORF2 (NphB) recombinant mutant S214Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcaggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 472 - DNA, 927 bp, Artificial Sequence
  ORF2 (NphB) recombinant mutant S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 473 - DNA, 927 bp, Artificial Sequence; identical to SEQ ID NO: 301
  ORF2 (NphB) recombinant mutant S214S

SEQ ID NO: 474 - DNA, 927 bp, Artificial Sequence
  ORF2 (NphB) recombinant mutant S214T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttaccgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 475 - DNA, 927 bp, Artificial Sequence
  ORF2 (NphB) recombinant mutant S214V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgttgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 476 - DNA, 927 bp, Artificial Sequence
  ORF2 (NphB) recombinant mutant S214W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttgggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 477 - DNA, 927 bp, Artificial Sequence
  ORF2 (NphB) recombinant mutant S214Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 478 - DNA, 927 bp, Artificial Sequence
  ORF2 (NphB) recombinant mutant A53A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggcaagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 479 - DNA, 927 bp, Artificial Sequence
  ORF2 (NphB) recombinant mutant A53C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtgtagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 480 - DNA, 927 bp, Artificial Sequence
  ORF2 (NphB) recombinant mutant A53D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 481 - DNA, 927 bp, Artificial Sequence
  ORF2 (NphB) recombinant mutant A53E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggaaagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 482 - DNA, 927 bp, Artificial Sequence
  ORF2 (NphB) recombinant mutant A53F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtttagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 483 - DNA, 927 bp, Artificial Sequence
  ORF2 (NphB) recombinant mutant A53G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgggtagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 484 - DNA, 927 bp, Artificial Sequence
  ORF2 (NphB) recombinant mutant A53H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 485 - DNA, 927 bp, Artificial Sequence
  ORF2 (NphB) recombinant mutant A53I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgattagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 486 - DNA, 927 bp, Artificial Sequence
  ORF2 (NphB) recombinant mutant A53K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaaaagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 487 - DNA, 927 bp, Artificial Sequence
  ORF2 (NphB) recombinant mutant A53L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgctgagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 488 - DNA, 927 bp, Artificial Sequence
  ORF2 (NphB) recombinant mutant A53M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgatgagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 489 - DNA, 927 bp, Artificial Sequence
  ORF2 (NphB) recombinant mutant A53N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 490 - DNA, 927 bp, Artificial Sequence
  ORF2 (NphB) recombinant mutant A53P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgccgagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 491 - DNA, 927 bp, Artificial Sequence
  ORF2 (NphB) recombinant mutant A53Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 492 - DNA, 927 bp, Artificial Sequence
  ORF2 (NphB) recombinant mutant A53R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcgtagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 493 - DNA, 927 bp, Artificial Sequence
  ORF2 (NphB) recombinant mutant A53S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgagcagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 494 - DNA, 927 bp, Artificial Sequence
  ORF2 (NphB) recombinant mutant A53T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 495 - DNA, 927 bp, Artificial Sequence
  ORF2 (NphB) recombinant mutant A53V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggttagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 496 - DNA, 927 bp, Artificial Sequence
  ORF2 (NphB) recombinant mutant A53W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtggagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 497 - DNA, 927 bp, Artificial Sequence
  ORF2 (NphB) recombinant mutant A53Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 498 - DNA, 927 bp, Artificial Sequence
  ORF2 (NphB) recombinant mutant V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 499 - DNA, 927 bp, Artificial Sequence
  ORF2 (NphB) recombinant mutant L219F, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 500 - DNA, 927 bp, Artificial Sequence
  ORF2 (NphB) recombinant mutant L219F, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 501 - DNA, 927 bp, Artificial Sequence
  ORF2 (NphB) recombinant mutant V294N, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaacgcgcgtggcctgctgaaagcgtttgactctttggaagattaatga

SEQ ID NO: 502 - DNA, 927 bp, Artificial Sequence
  ORF2 (NphB) recombinant mutant L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 503 - DNA, 927 bp, Artificial Sequence
  ORF2 (NphB) recombinant mutant V49A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 504 - DNA, 927 bp, Artificial Sequence
  ORF2 (NphB) recombinant mutant V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 505 - DNA, 927 bp, Artificial Sequence
  ORF2 (NphB) recombinant mutant V49A, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 506 - DNA, 927 bp, Artificial Sequence
  ORF2 (NphB) recombinant mutant Q161S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 507 - DNA, 927 bp, Artificial Sequence
  ORF2 (NphB) recombinant mutant V49A, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 508 - DNA, 927 bp, Artificial Sequence
  ORF2 (NphB) recombinant mutant S177Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 509 - DNA, 927 bp, Artificial Sequence
  ORF2 (NphB) recombinant mutant Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 510 - DNA, 927 bp, Artificial Sequence
  ORF2 (NphB) recombinant mutant A53Q, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 511 - DNA, 927 bp, Artificial Sequence
  ORF2 (NphB) recombinant mutant S177Y, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 512 - DNA, 927 bp, Artificial Sequence
  ORF2 (NphB) recombinant mutant A53Q, S177Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 513 - DNA, 927 bp, Artificial Sequence
  ORF2 (NphB) recombinant mutant D166E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 514 - DNA, 927 bp, Artificial Sequence
  ORF2 (NphB) recombinant mutant A53T, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 515 - DNA, 927 bp, Artificial Sequence
  ORF2 (NphB) recombinant mutant D166E, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 516 - DNA, 927 bp, Artificial Sequence
  ORF2 (NphB) recombinant mutant A53T D166E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 517 - DNA, 927 bp, Artificial Sequence
  ORF2 (NphB) recombinant mutant F123H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 518 - DNA, 927 bp, Artificial Sequence
  ORF2 (NphB) recombinant mutant L174V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 519 - DNA, 927 bp, Artificial Sequence
  ORF2 (NphB) recombinant mutant S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 520 - DNA, 927 bp, Artificial Sequence
  ORF2 (NphB) recombinant mutant F123H, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 521 - DNA, 927 bp, Artificial Sequence
  ORF2 (NphB) recombinant mutant L174V, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 522 - DNA, 927 bp, Artificial Sequence
  ORF2 (NphB) recombinant mutant F123H, L174V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 523 - DNA, 927 bp, Artificial Sequence
  ORF2 (NphB) recombinant mutant M106E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 524 - DNA, 927 bp, Artificial Sequence
  ORF2 (NphB) recombinant mutant A53T, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 525 - DNA, 927 bp, Artificial Sequence
  ORF2 (NphB) recombinant mutant M106E, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 526 - DNA, 927 bp, Artificial Sequence
  ORF2 (NphB) recombinant mutant A53T, M106E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 527 - DNA, 927 bp, Artificial Sequence
  ORF2 (NphB) recombinant mutant Q38G
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 528 - DNA, 927 bp, Artificial Sequence; identical to SEQ ID NO: 513
  ORF2 (NphB) recombinant mutant D166E

SEQ ID NO: 529 - DNA, 927 bp, Artificial Sequence
  ORF2 (NphB) recombinant mutant Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 530 - DNA, 927 bp, Artificial Sequence
  ORF2 (NphB) recombinant mutant Q38G, Q295A
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 531 - DNA, 927 bp, Artificial Sequence
  ORF2 (NphB) recombinant mutant D166E, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 532 - DNA, 927 bp, Artificial Sequence
  ORF2 (NphB) recombinant mutant Q38G, D166E
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 533 - DNA, 927 bp, Artificial Sequence
  ORF2 (NphB) recombinant mutant K118N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 534 - DNA, 927 bp, Artificial Sequence
  ORF2 (NphB) recombinant mutant S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 535 - DNA, 927 bp, Artificial Sequence
  ORF2 (NphB) recombinant mutant A53T, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 536 - DNA, 927 bp, Artificial Sequence
  ORF2 (NphB) recombinant mutant K118N, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 537 - DNA, 927 bp, Artificial Sequence
  ORF2 (NphB) recombinant mutant A53T, K118N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 538 - DNA, 927 bp, Artificial Sequence
  ORF2 (NphB) recombinant mutant S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 539 - DNA, 927 bp, Artificial Sequence; identical to SEQ ID NO: 502
  ORF2 (NphB) recombinant mutant L219F

SEQ ID NO: 540 - DNA, 927 bp, Artificial Sequence
  ORF2 (NphB) recombinant mutant S177W, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 541 - DNA, 927 bp, Artificial Sequence
  ORF2 (NphB) recombinant mutant A53Q, S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 542 - DNA, 927 bp, Artificial Sequence
  ORF2 (NphB) recombinant mutant A53Q, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 543 - DNA, 927 bp, Artificial Sequence
  ORF2 (NphB) recombinant mutant A108G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 544 - DNA, 927 bp, Artificial Sequence
  ORF2 (NphB) recombinant mutant G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 545 - DNA, 927 bp, Artificial Sequence
  ORF2 (NphB) recombinant mutant A108G, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 546 - DNA, 927 bp, Artificial Sequence
  ORF2 (NphB) recombinant mutant Q161S, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 547 - DNA, 927 bp, Artificial Sequence
  ORF2 (NphB) recombinant mutant A108G, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 548 - DNA, 927 bp, Artificial Sequence
  ORF2 (NphB) recombinant mutant K118Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 549 - DNA, 927 bp, Artificial Sequence
  ORF2 (NphB) recombinant mutant M162A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 550 - DNA, 927 bp, Artificial Sequence
  ORF2 (NphB) recombinant mutant Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 551 - DNA, 927 bp, Artificial Sequence
  ORF2 (NphB) recombinant mutant V271E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 552 - DNA, 927 bp, Artificial Sequence
  ORF2 (NphB) recombinant mutant K119D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 553 - DNA, 927 bp, Artificial Sequence
  ORF2 (NphB) recombinant mutant L274V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcctgctgaaagcgtttgactctttggaagattaatga

SEQ ID NO: 554 - DNA, 927 bp, Artificial Sequence
  ORF2 (NphB) recombinant mutant A232S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 555 - DNA, 927 bp, Artificial Sequence
  ORF2 (NphB) recombinant mutant Q161A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 556 - DNA, 927 bp, Artificial Sequence
  ORF2 (NphB) recombinant mutant G205L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 557 - DNA, 927 bp, Artificial Sequence; identical to SEQ ID NO: 463
  ORF2 (NphB) recombinant mutant S214G

SEQ ID NO: 558 - DNA, 927 bp, Artificial Sequence
  ORF2 (NphB) recombinant mutant Y216A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 559 - DNA, 927 bp, Artificial Sequence
  ORF2 (NphB) recombinant mutant N173D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 560 - DNA, 927 bp, Artificial Sequence
  ORF2 (NphB) recombinant mutant F123W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 561 - DNA, 927 bp, Artificial Sequence; identical to SEQ ID NO: 533
  ORF2 (NphB) recombinant mutant K118N

SEQ ID NO: 562 - DNA, 927 bp, Artificial Sequence
  ORF2 (NphB) recombinant mutant R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 563 - DNA, 927 bp, Artificial Sequence; identical to SEQ ID NO: 436
  ORF2 (NphB) recombinant mutant Q161W

SEQ ID NO: 564 - DNA, 927 bp, Artificial Sequence
  ORF2 (NphB) recombinant mutant V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 565 - DNA, 927 bp, Artificial Sequence; identical to SEQ ID NO: 472
  ORF2 (NphB) recombinant mutant S214R

SEQ ID NO: 566 - DNA, 927 bp, Artificial Sequence
  ORF2 (NphB) recombinant mutant G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 567 - DNA, 927 bp, Artificial Sequence
  ORF2 (NphB) recombinant mutant R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 568 - DNA, 927 bp, Artificial Sequence
  ORF2 (NphB) recombinant mutant C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 569 - DNA, 927 bp, Artificial Sequence
  ORF2 (NphB) recombinant mutant D227E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 570 - DNA, 927 bp, Artificial Sequence
  ORF2 (NphB) recombinant mutant M162F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 571 - DNA, 927 bp, Artificial Sequence
  ORF2 (NphB) recombinant mutant F123A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 572 - DNA, 927 bp, Artificial Sequence
  ORF2 (NphB) recombinant mutant A53T, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 573 - DNA, 927 bp, Artificial Sequence
  ORF2 (NphB) recombinant mutant A53T, Q161S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 574 - DNA, 927 bp, Artificial Sequence
  ORF2 (NphB) recombinant mutant A53T, Q161S, V294Nqq
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 575 - DNA, 927 bp, Artificial Sequence
  ORF2 (NphB) recombinant mutant A53T, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 576 - DNA, 927 bp, Artificial Sequence
  ORF2 (NphB) recombinant mutant Q161S, V294A, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcggcacgtggcctgctgaaagcgtttgactctttggaagattaatga

SEQ ID NO: 577 - DNA, 927 bp, Artificial Sequence
  ORF2 (NphB) recombinant mutant A53T, Q161S, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 578 - DNA, 927 bp, Artificial Sequence
  ORF2 (NphB) recombinant mutant A53T, V294A, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcggcacgtggcctgctgaaagcgtttgactctttggaagattaatga

SEQ ID NO: 579 - DNA, 927 bp, Artificial Sequence
  ORF2 (NphB) recombinant mutant A53T, Q161S, V294A, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcggcacgtggcctgctgaaagcgtttgactctttggaagattaatga

SEQ ID NO: 580 - DNA, 927 bp, Artificial Sequence
  ORF2 (NphB) recombinant mutant A53T, Q161S, V294N, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaacgcacgtggcctgctgaaagcgtttgactctttggaagattaatga

SEQ ID NO: 581 - DNA, 927 bp, Artificial Sequence; identical to SEQ ID NO: 514
  ORF2 (NphB) recombinant mutant A53T, Q295W

SEQ ID NO: 582 - DNA, 927 bp, Artificial Sequence
  ORF2 (NphB) recombinant mutant Q161S, V294A, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgtggcgtggcctgctgaaagcgtttgactctttggaagattaatga

SEQ ID NO: 583 - DNA, 927 bp, Artificial Sequence
  ORF2 (NphB) recombinant mutant A53T, Q161S, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 584 - DNA, 927 bp, Artificial Sequence
  ORF2 (NphB) recombinant mutant A53T, V294A, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgtggcgtggcctgctgaaagcgtttgactctttggaagattaatga

SEQ ID NO: 585 - DNA, 927 bp, Artificial Sequence
  ORF2 (NphB) recombinant mutant A53T, Q161S, V294A, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgtggcgtggcctgctgaaagcgtttgactctttggaagattaatga

SEQ ID NO: 586 - DNA, 927 bp, Artificial Sequence
  ORF2 (NphB) recombinant mutant A53T, Q161S, V294N, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaactggcgtggcctgctgaaagcgtttgactctttggaagattaatga

SEQ ID NO: 587 - DNA, 927 bp, Artificial Sequence
  ORF2 (NphB) recombinant mutant S177W, Q295
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 588 - DNA, 927 bp, Artificial Sequence
  ORF2 (NphB) recombinant mutant S177W, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 589 - DNA, 927 bp, Artificial Sequence
  ORF2 (NphB) recombinant mutant Q161S, S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 590 - DNA, 927 bp, Artificial Sequence
  ORF2 (NphB) recombinant mutant A53T, S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 591 - DNA, 927 bp, Artificial Sequence
  ORF2 (NphB) recombinant mutant V49A, Q295L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttctgcgtggcctgctgaaagcgtttgactctttggaagattaatga

SEQ ID NO: 592 - DNA, 927 bp, Artificial Sequence
  ORF2 (NphB) recombinant mutant V49A, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 593 - DNA, 927 bp, Artificial Sequence
  ORF2 (NphB) recombinant mutant A53T, Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 594 - DNA, 927 bp, Artificial Sequence
  ORF2 (NphB) recombinant mutant A53T, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 595 - DNA, 927 bp, Artificial Sequence; identical to SEQ ID NO: 524
  ORF2 (NphB) recombinant mutant A53T, A161S

SEQ ID NO: 596 - DNA, 927 bp, Artificial Sequence
  ORF2 (NphB) recombinant mutant Q161S, Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 597 - DNA, 927 bp, Artificial Sequence
  ORF2 (NphB) recombinant mutant Q161S, Q295L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttctgcgtggcctgctgaaagcgtttgactctttggaagattaatga

SEQ ID NO: 598 - DNA, 927 bp, Artificial Sequence
  ORF2 (NphB) recombinant mutant Q161S, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 599 - DNA, 927 bp, Artificial Sequence
  ORF2 (NphB) recombinant mutant S214R, Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 600 - DNA, 927 bp, Artificial Sequence; identical to SEQ ID NO: 507
  ORF2 (NphB) recombinant mutant V49A, Q161S

SEQ ID NO: 601 - DNA, 879 bp, Myxococcus stipitatus
atgccggcgctgtccttgggtcttgaacgtttgtgtgcagacgttgaggccgcagcagcgctggcaggcgcgagcttcagccgcgaggtgacgcgtaatgttctgaaaagctacccgcgctttttcaccagcagcgcggtcagcttccgcaccagcacgcgtaaaccggagaagcgtgagctgaacgtccgctttgttgaactggaaacccctgaggatccgcacgctgttgccctggcagagggcctgattcaccgcagcggccacccgattgacgacctgtttgagcaagtccaacgtaacgtgccgattctgggttatggtctggacttcggtgtggcttatggtgtggaaaagatctggccgtttttcccgcatcgccctcagccactggaagttctgcgtacgctgccgtccttgccgcaaagcgtgcaggcgcatagcggctttctggttgaacacgatctgacggatctcagcctgtttgcgctggactaccgttctcgctcggttaatctgtatttcatgtgccgtccgggtcactttagcaccgcacagttggcggatctgctgggcggtctgggttttgaaagcccgggtgaagaactgttggagcactgtacccgtgcggtcccgatctacttcaccttccgttgggaccgtccgcgtattgagcgtgtctgcttcggcgtcatcgcgccaggtccgggtctgttaccgacccatctgcacccgatcatcggccagttcgctgccggtgtgccgtttgccactgagcgtcgtaacttcatttacagcgttaccgtgtcccgcgaggaaaccttcattaagatcgagaatgattactctggcactatgacggcgctgatgcaagtgttt

SEQ ID NO: 602 - protein, 293 aa, Myxococcus stipitatus
MPALSLGLERLCADVEAAAALAGASFSREVTRNVLKSYPRFFTSSAVSFRTSTRKPEKRELNVRFVELETPEDPHAVALAEGLIHRSGHPIDDLFEQVQRNVPILGYGLDFGVAYGVEKIWPFFPHRPQPLEVLRTLPSLPQSVQAHSGFLVEHDLTDLSLFALDYRSRSVNLYFMCRPGHFSTAQLADLLGGLGFESPGEELLEHCTRAVPIYFTFRWDRPRIERVCFGVIAPGPGLLPTHLHPIIGQFAAGVPFATERRNFIYSVTVSREETFIKIENDYSGTMTALMQVF

SEQ ID NO: 603 - DNA, 1260 bp, Aspergillus terreus
atgggaccactagggtcccgtccgtggcagatcctgtcacaggctttgggtttcccgaactatgaccaggagctttggtggcagaataccgcagagacattgaatcgtgtattagagcaatgcgattactcagtacaccttcagtataagtacctggccttctatcacaagtatatcctgccctcactaggaccttttaggagaccaggtgtcgagccagagtacatcagcggattatcacatggcggccacccactagaaatctccgtaaaaatagataagtcaaaaacgatttgcaggttgggccttcaagctatagggccgctggcagggacagctagggacccactgaactcattcggggacagggaactgttgaagaatctagccactcttctaccccatgtagacctacgtctattcgatcactttaacgcccaagtgggtttagatagggcgcagtgcgcagtggcaactacgaaacttattaaagaatcacataatattgtttgtacaagtctggatttaaaggacggcgaagtgataccgaaagtttacttctcaacgatccccaagggactggtcacggaaacgccccttttcgaccttacttttgctgccattgagcaaatggaagtgtatcataaggacgcgccgctgaggacagccttatcatccttgaaggactttttgcgtccgcgtgtcccgacggacgcttcaattaccccgcctctaactgggttaataggggtcgattgcatcgatccaatgctaagccgtttgaaggtatatttagccaccttcaggatggacctgagccttatccgtgattattggactcttggcggacttttgacggatgctgggactatgaaagggttagaaatggttgagactctggccaagaccctaaaactaggagatgaagcatgcgaaacccttgatgcagaacgtttgcccttcggaattaattatgctatgaagcccggaaccgccgaattggcacccccacagatatactttccgttgctaggaatcaacgatggattcattgcagacgccttagtcgagttttttcagtacatgggctgggaggatcaggccaatagatataaagatgaattgaaggcaaagttccccaatgtagatatatctcaaacgaagaacgttcaccgttggctaggggtcgcatatagcgaaacgaaaggtccaagtatgaacatatattacgacgtcgtcgcaggcaacgtggcgagggtc

SEQ ID NO: 604 - protein, 420 aa, Aspergillus terreus
MGPLGSRPWQILSQALGFPNYDQELWWQNTAETLNRVLEQCDYSVHLQYKYLAFYHKYILPSLGPFRRPGVEPEYISGLSHGGHPLEISVKIDKSKTICRLGLQAIGPLAGTARDPLNSFGDRELLKNLATLLPHVDLRLFDHFNAQVGLDRAQCAVATTKLIKESHNIVCTSLDLKDGEVIPKVYFSTIPKGLVTETPLFDLTFAAIEQMEVYHKDAPLRTALSSLKDFLRPRVPTDASITPPLTGLIGVDCIDPMLSRLKVYLATFRMDLSLIRDYWTLGGLLTDAGTMKGLEMVETLAKTLKLGDEACETLDAERLPFGINYAMKPGTAELAPPQIYFPLLGINDGFIADALVEFFQYMGWEDQANRYKDELKAKFPNVDISQTKNVHRWLGVAYSETKGPSMNIYYDVVAGNVARV

The invention claimed is:

1. A method of producing at least one prenylated product, comprising, contacting a recombinant polypeptide with a substrate and a prenyl donor, thereby producing at least one prenylated product, wherein the recombinant polypeptide produces a ratio of an amount of the at least one prenylated product to an amount of total prenylated products that is higher than a prenyl transferase comprising the amino acid sequence of SEQ ID NO: 1 under the same condition, wherein the recombinant polypeptide comprises an amino acid sequence sharing at least 80% sequence identity with the amino acid sequence of SEQ ID NO: 1, and wherein the recombinant polypeptide comprises:

(a) two or more amino acid substitutions relative to SEQ ID NO: 1 selected from the group consisting of:

A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K1180, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y2880, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) two or more sets of amino acid substitutions relative to SEQ ID NO: 1 selected from the group consisting of:

A53T and S214R; S177W and Q295A; S214R and Q295F; Q161S and S214R; S177W and S214R; Q161S and Q295L; Q161S and Q295F; V49A and S214R; A53T and Q295F; Q161S and S177W; Q161S, V294A and Q295W; A53T, Q161S and Q295W; A53T and S177W; A53T, Q161S, V294A and Q295W; A53T, V294A and Q295A; V49A and Q295L; A53T, Q161S, V294N and Q295W; A53T and Q295A; Q161S, V294A and Q295A; A53T and Q295W; A53T, V294A and Q295W; A53T, Q161S and Q295A; A53T, Q161S, V294A and Q295A; and A53T, Q161S, V294N and Q295A.

2. A method of producing at least one prenylated product, comprising, a) contacting a first recombinant polypeptide with a substrate and a first prenyl donor, thereby producing a first prenylated product; and b) contacting the first prenylated product and a second prenyl donor with a second recombinant polypeptide, thereby producing a second prenylated product, wherein the first recombinant polypeptide and/or the second recombinant polypeptide produces a ratio of an amount of the at least one prenylated product to an amount of total prenylated products that is higher than a prenyl transferase comprising the amino acid sequence of SEQ ID NO: 1 under the same condition, wherein the first recombinant polypeptide and/or the second recombinant polypeptide comprises an amino acid sequence sharing at least 80% sequence identity with the amino acid sequence of SEQ ID NO: 1, and wherein the first recombinant polypeptide and/or the second recombinant polypeptide comprises:

(a) two or more amino acid substitutions relative to SEQ ID NO: 1 selected from the group consisting of:

A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) two or more sets of amino acid substitutions relative to SEQ ID NO: 1 selected from the group consisting of:

A53T and S214R; S177W and Q295A; S214R and Q295F; Q161S and S214R; S177W and S214R; Q161S and Q295L; Q161S and Q295F; V49A and S214R; A53T and Q295F; Q161S and S177W; Q161S, V294A and Q295W; A53T, Q161S and Q295W; A53T and S177W; A53T, Q161S, V294A and Q295W; A53T, V294A and Q295A; V49A and Q295L; A53T, Q161S, V294N and Q295W; A53T and Q295A; Q161S, V294A and Q295A; A53T and Q295W; A53T, V294A and Q295W; A53T, Q161S and Q295A; A53T, Q161S, V294A and Q295A; and A53T, Q161S, V294N and Q295A.

3. The method of claim 1, wherein said amino acid sequence of the recombinant polypeptide shares at least 95%, 96%, 97%, 98%, or 99% sequence identity with the amino acid sequence of SEQ ID NO: 1.

4. The method of claim 1, wherein the prenyl donor is selected from the group consisting of DMAPP, GPP, FPP, GGPP, and any combination thereof.

5. The method of claim 1, wherein the substrate is selected from the group consisting of olivetolic acid (OA), divarinolic acid (DVA), olivetol (O), divarinol (DV), orsellinic acid (ORA), dihydroxybenzoic acid (DHBA), apigenin, naringenin and resveratrol.

6. The method of claim 1, wherein the at least one prenylated product comprises a prenyl group attached to any position on an aromatic ring of the substrate.

7. The method of claim 1, wherein the at least one prenylated product is selected from the group consisting of UNK1, UNK2, UNK3, RBI-08, RBI-17 (5-DOA), RBI-05, RBI-06, 4-O-GOA, RBI-02 (CBGA), RBI-04 (5-GOA), UNK4, RBI-56, UNK5,RBI-14 (CBFA), RBI-16 (5-FOA), RBI-24, RBI-28, RBI-26 (CBGVA), RBI-27, RBI-38, RBI-39, RBI-09, RB1-10, RBI-03 (5-GO), RBI-20, RBI-01 (CBG), RBI-15, RBI-34, RBI-32, RBI-33, RB1-07, RBI-29, RBI-30, RBI-12, and RBI-11.

8. The method of claim 1, wherein the substrate is a prenylated molecule.

9. The method of claim 8, wherein the prenylated molecule is selected from the group consisting of UNK1, UNK2, UNK3, RBI-08, 5-DOA, RBI-05, RBI-06, 4-O-GOA, RBI-02 (CBGA), RBI-04 (5-GOA), UNK4, RBI-56, UNK5, RBI-14 (CBFA), RBI-16 (5-FOA), RBI-24, RBI-28, RBI-26 (CBGVA), RBI-27, RBI-38, RBI-39, RBI-09, RBI-10, RBI-03 (5-GO), RBI-20, RBI-01 (CBG), RBI-15, RBI-34, RBI-32, RBI-33, RB1-07, RBI-29, RBI-30, RBI-12, and RBI-11.

10. The method of claim 2, wherein the first recombinant polypeptide is the same as the second recombinant polypeptide.

11. The method of claim 2, wherein the first recombinant polypeptide is different from the second recombinant polypeptide.

12. The method of claim 2, wherein the first prenyl donor is the same as the second prenyl donor.

13. The method of claim 2, wherein the first prenyl donor is different from the second prenyl donor.

14. The method of claim 2, wherein the first prenylated product is different from the second prenylated product.

* * * * *